US008734809B2

(12) United States Patent
Gao et al.

(10) Patent No.: US 8,734,809 B2
(45) Date of Patent: May 27, 2014

(54) AAV'S AND USES THEREOF

(75) Inventors: Guangping Gao, Westborough, MA (US); Terence Flotte, Holden, MA (US); Jun Xie, Worcester, MA (US)

(73) Assignee: University of Massachusetts, Boston, MA (US)

( * ) Notice: Subject to any disclaimer, the term of this patent is extended or adjusted under 35 U.S.C. 154(b) by 23 days.

(21) Appl. No.: 13/322,164

(22) PCT Filed: Apr. 23, 2010

(86) PCT No.: PCT/US2010/032158
§ 371 (c)(1),
(2), (4) Date: Feb. 15, 2012

(87) PCT Pub. No.: WO2010/138263
PCT Pub. Date: Dec. 2, 2010

(65) Prior Publication Data
US 2012/0137379 A1 May 31, 2012

Related U.S. Application Data

(60) Provisional application No. 61/182,084, filed on May 28, 2009.

(51) Int. Cl.
*A61K 39/23* (2006.01)
*A61K 39/235* (2006.01)
*A61K 39/12* (2006.01)
*C12N 15/00* (2006.01)
*C12P 21/06* (2006.01)

(52) U.S. Cl.
USPC .................. 424/233.1; 424/186.1; 435/320.1; 435/69.1

(58) Field of Classification Search
None
See application file for complete search history.

(56) References Cited

U.S. PATENT DOCUMENTS

| | | | |
|---|---|---|---|
| 5,043,270 A | 8/1991 | Abrams et al. | |
| 5,478,745 A | 12/1995 | Samulski et al. | |
| 5,871,982 A | 2/1999 | Wilson et al. | |
| 6,001,650 A | 12/1999 | Colosi | |
| 6,083,716 A | 7/2000 | Wilson et al. | |
| 6,156,303 A | 12/2000 | Russell et al. | |
| 6,177,403 B1 | 1/2001 | Stedman | |
| 6,251,677 B1 | 6/2001 | Wilson et al. | |

(Continued)

FOREIGN PATENT DOCUMENTS

| | | |
|---|---|---|
| WO | WO 03/042397 A2 | 5/2003 |
| WO | WO 03/093460 A1 | 11/2003 |

(Continued)

OTHER PUBLICATIONS

Wilson et al., 2005, Geneseq Accession No. ADZ26851, computer printout, pp. 15-18.*

(Continued)

*Primary Examiner* — Michelle S Horning
*Assistant Examiner* — M. Franco Salvoza
(74) *Attorney, Agent, or Firm* — Wolf, Greenfield & Sacks, P.C.

(57) ABSTRACT

The invention in some aspects relates to recombinant adeno-associated viruses having distinct tissue targeting capabilities. In some aspects, the invention relates to gene transfer methods using the recombinant adeno-associate viruses. In some aspects, the invention relates to isolated AAV capsid proteins and isolated nucleic acids encoding the same.

51 Claims, 13 Drawing Sheets

(56) References Cited

U.S. PATENT DOCUMENTS

| | | |
|---|---|---|
| 6,365,394 B1 | 4/2002 | Gao et al. |
| 6,475,469 B1 | 11/2002 | Montgomery |
| 6,485,966 B2 | 11/2002 | Gao et al. |
| 6,498,244 B1 | 12/2002 | Patel et al. |
| 6,821,512 B1 | 11/2004 | Gao et al. |
| 6,953,690 B1 | 10/2005 | Gao et al. |
| 6,962,815 B2 | 11/2005 | Bartlett |
| 7,022,519 B2 | 4/2006 | Gao et al. |
| 7,198,951 B2 | 4/2007 | Gao et al. |
| 7,235,393 B2 | 6/2007 | Gao et al. |
| 7,238,526 B2 | 7/2007 | Wilson et al. |
| 7,247,472 B2 | 7/2007 | Wilson et al. |
| 7,282,199 B2 | 10/2007 | Gao et al. |
| 7,344,872 B2 | 3/2008 | Gao et al. |
| 7,427,396 B2 | 9/2008 | Arbetman et al. |
| 2002/0019050 A1 | 2/2002 | Gao et al. |
| 2003/0040101 A1 | 2/2003 | Wilson et al. |
| 2003/0092161 A1 | 5/2003 | Gao et al. |
| 2003/0096399 A1 | 5/2003 | Barber et al. |
| 2003/0119191 A1 | 6/2003 | Gao et al. |
| 2003/0138772 A1 | 7/2003 | Gao et al. |
| 2003/0207259 A1 | 11/2003 | Gao et al. |
| 2003/0228282 A1 | 12/2003 | Gao et al. |
| 2004/0136963 A1 | 7/2004 | Wilson et al. |
| 2004/0171807 A1 | 9/2004 | Gao et al. |
| 2005/0014262 A1 | 1/2005 | Gao et al. |
| 2005/0032219 A1 | 2/2005 | Aubourg et al. |
| 2005/0037988 A1 | 2/2005 | Zamore et al. |
| 2005/0069866 A1 | 3/2005 | Wilson et al. |
| 2005/0137153 A1 | 6/2005 | McSwiggen et al. |
| 2006/0018841 A1 | 1/2006 | Arbetman et al. |
| 2006/0292117 A1 | 12/2006 | Loiler et al. |
| 2007/0004042 A1 | 1/2007 | Gao et al. |
| 2007/0036760 A1 | 2/2007 | Wilson et al. |
| 2007/0134203 A1 | 6/2007 | Gao et al. |
| 2007/0292410 A1 | 12/2007 | Cashman et al. |
| 2008/0075737 A1 | 3/2008 | Gao et al. |
| 2008/0075740 A1 | 3/2008 | Gao et al. |
| 2008/0090281 A1 | 4/2008 | Wilson et al. |
| 2008/0219954 A1 | 9/2008 | Gao et al. |
| 2008/0292595 A1 | 11/2008 | Arbetman et al. |
| 2009/0111766 A1 | 4/2009 | Atkinson et al. |
| 2009/0131355 A1 | 5/2009 | Bot et al. |
| 2009/0149409 A1 | 6/2009 | Bohn et al. |
| 2010/0028998 A1 | 2/2010 | Roelvink et al. |
| 2010/0104561 A1 | 4/2010 | Zhong et al. |
| 2010/0186103 A1 | 7/2010 | Gao et al. |
| 2013/0101558 A1 | 4/2013 | Gao et al. |
| 2013/0195801 A1 | 8/2013 | Gao et al. |

FOREIGN PATENT DOCUMENTS

| | | |
|---|---|---|
| WO | WO 2005/033321 A2 | 4/2005 |
| WO | WO 2006119432 A2 * | 11/2006 |
| WO | WO 2008/091703 A2 | 7/2008 |
| WO | WO 2008/147839 A1 | 12/2008 |
| WO | WO 2009/130208 A1 | 10/2009 |
| WO | WO 2010/034314 A1 | 4/2010 |

OTHER PUBLICATIONS

Jackman et al., "Stabilization of the oxy form of tyrosinase by a single conservative amino acid substitution," Biochem J 282, pp. 915-918 (1992).*

GENBANK Submission; NCBI, Accession No. AAS99264; Gao et al.; Jun. 24, 2004.

GENBANK Submission; NCBI, Accession No. ABA71701; Schmidt et al.; May 10, 2006.

GENBANK Submission; NCBI, Accession No. ACB55301; Vandenberghe et al.; Jul. 31, 2008.

GENBANK Submission; NCBI, Accession No. NP_049542; Xiao et al.; Mar. 11, 2010.

GENBANK Submission; NCBI, Accession No. YP_680426; Ruffing et al.; Nov. 19, 2010.

GENBANK Submission; NCBI, Accession No. ACB55310; Vandenberghe et al.; Jul. 31, 2008.

GENBANK Submission; NCBI, Accession No. AAB95450; Rutledge et al.; Jan. 12, 1998.

Afione et al., In vivo model of adeno-associated virus vector persistence and rescue. J Virol. May 1996;70(5):3235-41.

Akache et al., The 37/67-kilodalton laminin receptor is a receptor for adeno-associated virus serotypes 8, 2, 3, and 9. J Virol. Oct. 2006;80(19):9831-6.

Ameres et al., Target RNA-directed tailing and trimming purifies the sorting of endo-siRNAs between the two Drosophila Argonaute proteins. RNA. Jan. 2011;17(1):54-63. doi: 10.1261/rna.2498411. Epub Nov. 24, 2010.

Ameres et al., Target RNA-directed trimming and tailing of small silencing RNAs. Science. Jun. 18, 2010;328(5985):1534-9. doi: 10.1126/science.1187058.

Arbetman et al., Novel caprine adeno-associated virus (AAV) capsid (AAV-Go.1) is closely related to the primate AAV-5 and has unique tropism and neutralization properties. J Virol. Dec. 2005;79(24):15238-45.

Bals et al., Transduction of well-differentiated airway epithelium by recombinant adeno-associated virus is limited by vector entry. J Virol. Jul. 1999;73(7):6085-8.

Berns et al., Biology of adeno-associated virus. Curr Top Microbiol Immunol. 1996;218:1-23.

Berns et al., Detection of adeno-associated virus (AAV)-specific nucleotide sequences in DNA isolated from latently infected Detroit 6 cells. Virology. Dec. 1975;68(2):556-60.

Beutler et al., AAV for pain: steps towards clinical translation. Gene Ther. Apr. 2009;16(4):461-9. Epub Mar. 5, 2009.

Bish et al., Adeno-associated virus (AAV) serotype 9 provides global cardiac gene transfer superior to AAV1, AAV6, AAV7, and AAV8 in the mouse and rat. Hum Gene Ther. Dec. 2008;19(12):1359-68. doi: 10.1089/hum.2008.123.

Brantly et al., Phase I trial of intramuscular injection of a recombinant adeno-associated virus serotype 2 alpha1-antitrypsin (AAT) vector in AAT-deficient adults. Hum Gene Ther. Dec. 2006;17(12):1177-86.

Büssing et al., let-7 microRNAs in development, stem cells and cancer. Trends Mol Med. Sep. 2008;14(9):400-9. doi: 10.1016/j.molmed.2008.07.001. Epub Jul. 31, 2008.

Calcedo et al., Worldwide epidemiology of neutralizing antibodies to adeno-associated viruses. J Infect Dis. Feb. 1, 2009;199(3):381-90.

Carè et al., MicroRNA-133 controls cardiac hypertrophy. Nat Med. May 2007;13(5):613-8. Epub Apr. 29, 2007.

Carter et al., Adeno-associated virus gene expression and regulation. CRC Handbook of parvoviruses. 1990:227-54.

Chadderton et al., Improved retinal function in a mouse model of dominant retinitis pigmentosa following AAV-delivered gene therapy. Mol Ther. Apr. 2009;17(4):593-9. Epub Jan. 27, 2009.

Chang et al., miR-122, a mammalian liver-specific microRNA, is processed from her mRNA and may downregulate the high affinity cationic amino acid transporter CAT-1. RNA Jul. 2004;1(2):106-13. Epub Jul. 1, 2004.

Chen et al., Comparative study of anti-hepatitis B virus RNA interference by double-stranded adeno-associated virus serotypes 7, 8, and 9. Mol Ther. Feb. 2009;17(2):352-9. Epub Dec. 9, 2008.

Chen et al., Efficient transduction of vascular endothelial cells with recombinant adeno-associated virus serotype 1 and 5 vectors. Hum Gene Ther. Feb. 2005;16(2):235-47.

Chirmule et al., Humoral immunity to adeno-associated virus type 2 vectors following administration to murine and nonhuman primate muscle. J Virol. Mar. 2000;74(5):2420-5.

Choi et al., Effects of adeno-associated virus DNA hairpin structure on recombination. J Virol. Jun. 2005;79(11):6801-7.

Christensen et al., A let-7 microRNA-binding site polymorphism in the KRAS 3' UTR is associated with reduced survival in oral cancers. Carcinogenesis. Jun. 2009;30(6):1003-7. doi: 10.1093/carcin/bgp099. Epub Apr. 20, 2009.

Cideciyan et al., Human RPE65 gene therapy for Leber congenital amaurosis: persistence of early visual improvements and safety at 1 year. Hum Gene Ther. Sep. 2009;20(9):999-1004.

(56) References Cited

OTHER PUBLICATIONS

Conlon et al., Efficient hepatic delivery and expression from a recombinant adeno-associated virus 8 pseudotyped alpha1-antitrypsin vector. Mol Ther. Nov. 2005;12(5):867-75. Epub Aug. 8, 2005.

Conrad et al., Safety of single-dose administration of an adeno-associated virus (AAV)-CFTR vector in the primate lung. Gene Ther. Aug. 1996;3(8):658-68.

Coulouarn et al., Loss of miR-122 expression in liver cancer correlates with suppression of the hepatic phenotype and gain of metastatic properties. Oncogene. Oct. 8, 2009;28(40):3526-36. doi: 10.1038/onc.2009.211. Epub Jul. 20, 2009.

Crowe et al., A comparison in chimpanzees of the immunogenicity and efficacy of live attenuated respiratory syncytial virus (RSV) temperature-sensitive mutant vaccines and vaccinia virus recombinants that express the surface glycoproteins of RSV. Vaccine. Nov. 1993;11(14):1395-404.

Cruz et al., In vivo post-transcriptional gene silencing of alpha-1 antitrypsin by adeno-associated virus vectors expressing siRNA. Lab Invest. Sep. 2007;87(9):893-902. Epub Jun. 25, 2007.

Czech, MicroRNAs as therapeutic targets. N Engl J Med. Mar. 16, 2006;354(11):1194-5.

Davidoff et al., Sex significantly influences transduction of murine liver by recombinant adeno-associated viral vectors through an androgen-dependent pathway. Blood. Jul. 15, 2003;102(2):480-8. Epub Mar. 13, 2003.

Daya et al., Gene therapy using adeno-associated virus vectors. Clin Microbiol Rev. Oct. 2008;21(4):583-93. doi: 10.1128/CMR.00008-08.

Duque et al., Intravenous administration of self-complementary AAV9 enables transgene delivery to adult motor neurons. Mol Ther. Jul. 2009;17(7):1187-96. doi: 10.1038/mt.2009.71. Epub Apr. 14, 2009.

Eberling et al., Results from a phase I safety trial of hAADC gene therapy for Parkinson disease. Neurology. May 20, 2008;70(21):1980-3. doi: 10.1212/01.wnl.0000312381.29287.ff. Epub Apr. 9, 2008.

Ehlert et al., Cellular toxicity following application of adeno-associated viral vector-mediated RNA interference in the nervous system. BMC Neurosci. Feb. 18, 2010;11:20.

Elmén et al., Antagonism of microRNA-122 in mice by systemically administered LNA-antimiR leads to up-regulation of a large set of predicted target mRNAs in the liver. Nucleic Acids Res. Mar. 2008;36(4):1153-62. Epub Dec. 23, 2007.

Engelhardt et al., Adenovirus-mediated transfer of the CFTR gene to lung of nonhuman primates: biological efficacy study. Hum Gene Ther. Dec. 1993;4(6):759-69.

Esau et al., miR-122 regulation of lipid metabolism revealed by in vivo antisense targeting. Cell Metab. Feb. 2006;3(2):87-98.

Fabani et al., miR-122 targeting with LNA/2'-O-methyl oligonucleotide mixmers, peptide nucleic acids (PNA), and PNA-peptide conjugates. RNA. Feb. 2008;14(2):336-46. Epub Dec. 11, 2007.

Feigin et al., Modulation of metabolic brain networks after subthalamic gene therapy for Parkinson's disease. Proc Natl Acad Sci U S A. Dec. 4, 2007;104(49):19559-64. Epub Nov. 27, 2007.

Fischer et al., Successful transgene expression with serial doses of aerosolized rAAV2 vectors in rhesus macaques. Mol Ther. Dec. 2003;8(6):918-26.

Fisher et al., Transduction with recombinant adeno-associated virus for gene therapy is limited by leading-strand synthesis. J Virol. Jan. 1996;70(1):520-32.

Flotte et al., Phase I trial of intramuscular injection of a recombinant adeno-associated virus alpha 1-antitrypsin (rAAV2-CB-hAAT) gene vector to AAT-deficient adults. Hum Gene Ther. Jan. 2004;15(1):93-128.

Flotte, Recombinant adeno-associated virus (AAV) gene therapy vectors for, cystic fibrosis (CF), alpha-1-antitrypsin deficiency (AAT) and fatty oxidation disorders (FAO). Umass Medical School. Interdisciplinary Graduate Program. Last accessed at http://www.umassmed.edu/igp/faculty/flotte.cfm?start=0& on Aug. 27, 2009.

Forman et al., A search for conserved sequences in coding regions reveals that the let-7 microRNA targets Dicer within its coding sequence. Proc Natl Acad Sci U S A. Sep. 30, 2008;105(39):14879-84. doi: 10.1073/pnas.0803230105. Epub Sep. 23, 2008.

Foust et al., Intravascular AAV9 preferentially targets neonatal-neurons and adult-astrocytes in CNS. Nature Biotechnology. Jan. 2009; 27(1):59-65.

Fu et al., Self-complementary adeno-associated virus serotype 2 vector: global distribution and broad dispersion of AAV-mediated transgene expression in mouse brain. Mol Ther. Dec. 2003;8(6):911-7.

Gao et al., Adeno-associated viruses undergo substantial evolution in primates during natural infections. Proc Natl Acad Sci U S A. May 13, 2003;100(10):6081-6. Epub Apr. 25, 2003.

Gao et al., Adeno-associated virus-mediated gene transfer to nonhuman primate liver can elicit destructive transgene-specific T cell responses. Hum Gene Ther. Sep. 2009;20(9):930-42. doi: 10.1089/hum.2009.060.

Gao et al., Biology of AAV serotype vectors in liver-directed gene transfer to nonhuman primates. Mol Ther. Jan. 2006;13(1):77-87. Epub Oct. 10, 2005.

Gao et al., Clades of Adeno-associated viruses are widely disseminated in human tissues. J Virol. Jun. 2004;78(12):6381-8.

Gao et al., Erythropoietin gene therapy leads to autoimmune anemia in macaques. Blood. May 1, 2004;103(9):3300-2. Epub Dec. 24, 2003.

Gao et al., Inadvertent gene transfer of co-packaged rep and cap sequences during the production of AAV vector and its potential impact on vector performance. Molecular Therapy. May 2008;16(Suppl. 1):S105-S106. Abstract 279.

Gao et al., New recombinant serotypes of AAV vectors. Curr Gene Ther. Jun. 2005;5(3):285-97.

Gao et al., Novel adeno-associated viruses from rhesus monkeys as vectors for human gene therapy. Proc Natl Acad Sci U S A. Sep. 3, 2002;99(18):11854-9. Epub Aug. 21, 2002.

Gao et al., Purification of recombinant adeno-associated virus vectors by column chromatography and its performance in vivo. Hum Gene Ther. Oct. 10, 2000;11(15):2079-91.

Gao et al., RAAV-mediated targeting in adult mice and its potential in generating animal models of tissue-specific somatic transgenics or knock down. Molecular Therapy. May 2008;16(Suppl. 1):S118-S119. Abstract 316.

Gentner et al., Stable knockdown of microRNA in vivo by lentiviral vectors. Nat Methods. Jan. 2009;6(1):63-6. doi: 10.1038/nmeth.1277. Epub Nov. 30, 2008.

Girard et al., miR-122, a paradigm for the role of microRNAs in the liver. J Hepatol. Apr. 2008;48(4):648-56. doi: 10.1016/j.jhep.2008.01.019. Epub Feb. 12, 2008.

Gramantieri et al., Cyclin G1 is a target of miR-122a, a microRNA frequently down-regulated in human hepatocellular carcinoma. Cancer Res. Jul. 1, 2007;67(13):6092-9.

Griffiths-Jones et al., miRBase: microRNA sequences, targets and gene nomenclature. Nucleic Acids Res. Jan. 1, 2006;34(Database issue):D140-4.

Hauswirth et al., Treatment of leber congenital amaurosis due to RPE65 mutations by ocular subretinal injection of adeno-associated virus gene vector: short-term results of a phase I trial. Hum Gene Ther. Oct. 2008;19(10):979-90.

Hernandez et al., Latent adeno-associated virus infection elicits humoral but not cell-mediated immune responses in a nonhuman primate model. J Virol. Oct. 1999;73(10):8549-58.

Hildinger et al., Hybrid vectors based on adeno-associated virus serotypes 2 and 5 for muscle-directed gene transfer. J Virol. Jul. 2001;75(13):6199-203.

Horwich et al., Design and delivery of antisense oligonucleotides to block microRNA function in cultured Drosophila and human cells. Nat Protoc. 2008;3(10):1537-49. doi: 10.1038/nprot.2008.145.

Hutvágner et al., Sequence-specific inhibition of small RNA function. PLoS Biol. Apr. 2004;2(4):E98. Epub Feb. 24, 2004.

Johnson et al., RAS is regulated by the let-7 microRNA family. Cell. Mar. 11, 2005;120(5):635-47.

Kaspar et al., Retrograde viral delivery of IGF-1 prolongs survival in a mouse ALS model. Science. Aug. 8, 2003;301(5634):839-42.

(56) References Cited

OTHER PUBLICATIONS

Kota et al., Therapeutic microRNA delivery suppresses tumorigenesis in a murine liver cancer model. Cell. Jun. 12, 2009;137(6):1005-17. doi: 10.1016/j.cell.2009.04.021.
Kotin et al., Organization of adeno-associated virus DNA in latently infected Detroit 6 cells. Virology. Jun. 1989;170(2):460-7.
Kotin et al., Site-specific integration by adeno-associated virus. Proc Natl Acad Sci U S A. Mar. 1990;887(6):2211-5.
Krützfeldt et al., Silencing of microRNAs in vivo with 'antagomirs'. Nature. Dec. 1, 2005;438(7068):685-9. Epub Oct. 30, 2005.
Kutay et al., Downregulation of miR-122 in the rodent and human hepatocellular carcinomas. J Cell Biochem. Oct. 15, 2006;99(3):671-8.
Lebherz et al., Gene therapy with novel adeno-associated virus vectors substantially diminishes atherosclerosis in a murine model of familial hypercholesterolemia. J Gene Med. Jun. 2004;6(6):663-72.
Lewis et al., Conserved seed pairing, often flanked by adenosines, indicates that thousands of human genes are microRNA targets. Cell. Jan. 14, 2005;120(1):15-20.
Lewis et al., Prediction of mammalian microRNA targets. Cell. Dec. 26, 2003;115(7):787-98.
Li et al., Ex vivo transduction and transplantation of bone marrow cells for liver gene delivery of alphal-antitrypsin. Mol Ther. Aug. 2010;18(8):1553-8. Epub Jun. 15, 2010.
Lin et al., Impact of preexisting vector immunity on the efficacy of adeno-associated virus-based HIV-1 Gag vaccines. Hum Gene Ther. Jul. 2008;19(7):663-9.
Liu et al., Biological Differences in rAAV Transduction of Airway Epithelia in Humans and in Old World Non-human Primates. Mol Ther. Dec. 2007;15(12):2114-23. Epub Jul. 31, 2007.
Liu et al., Comparative biology of rAAV transduction in ferret, pig and human airway epithelia. Gene Ther. Nov. 2007;14(21):1543-8. Epub Aug. 30, 2007.
Liu et al., Species-specific differences in mouse and human airway epithelial biology of recombinant adeno-associated virus transduction. Am J Respir Cell Mol Biol. Jan. 2006;34(1):56-64. Epub Sep. 29, 2005.
Lowenstein, Crossing the rubicon. Nat Biotechnol. Jan. 2009;27(1):42-4.
Loya et al., Transgenic microRNA inhibition with spatiotemporal specificity in intact organisms. Nat Methods. Dec. 2009;6(12):897-903. doi: 10.1038/nmeth.1402. Epub Nov. 15, 2009.
Ma et al., Therapeutic silencing of miR-10b inhibits metastasis in a mouse mammary tumor model. Nat Biotechnol. Apr. 2010;28(4):341-7. doi: 10.1038/nbt.1618. Epub Mar. 28, 2010.
Mandel et al., Recombinant adeno-associated viral vectors as therapeutic agents to treat neurological disorders. Mol Ther. Mar. 2006;13(3):463-83. Epub Jan. 18, 2006.
Manfredsson et al., AAV9: a potential blood-brain barrier buster. Mol Ther. Mar. 2009;17(3):403-5.
Manno et al., Successful transduction of liver in hemophilia by AAV-Factor IX and limitations imposed by the host immune response. Nat Med. Mar. 2006;12(3):342-7. Epub Feb. 12, 2006. Erratum in: Nat Med. May 2006;12(5):592. Rasko, John [corrected to Rasko, John JE]; Rustagi, Pradip K [added].
McCarty et al., Integration of adeno-associated virus (AAV) and recombinant AAV vectors. Annu Rev Genet. 2004;38:819-45.
McCarty et al., Self-complementary recombinant adeno-associated virus (scAAV) vectors promote efficient transduction independently of DNA synthesis. Gene Ther. Aug. 2001;8(16):1248-54.
McCarty, Self-complementary AAV vectors; advances and applications. Mol Ther. Oct. 2008;16(10):1648-56. Epub Aug. 5, 2008.
McGovern, Taking aim at HDL-C. Raising levels to reduce cardiovascular risk. Postgrad Med. Apr. 2005;117(4):29-30, 33-5, 39, 44 passim.
Meister et al., Sequence-specific inhibition of microRNA- and siRNA-induced RNA silencing. RNA. Mar. 2004;10(3):544-50.
Mingozzi et al., CD8(+) T-cell responses to adeno-associated virus capsid in humans. Nat Med. Apr. 2007;13(4):419-22. Epub Mar. 18, 2007.
Moss et al., Repeated adeno-associated virus serotype 2 aerosol-mediated cystic fibrosis transmembrane regulator gene transfer to the lungs of patients with cystic fibrosis: a multicenter, double-blind, placebo-controlled trial. Chest. Feb. 2004;125(2):509-21.
Mueller et al., Development of Simultaneous Gene Augmentation and Reduction of Mutant Gene Expression with a Single Recombinant AAV for Alpha-1 Antitrypsin Disease. Molecular Therapy May 2009;17(1):S391-S392. Abstract 1030.
Mueller et al., In Vivo AAV Delivered Allele Specific shRNA for the Knockdown of Alpha-1 Antitrypsin. Molecular Therapy May 2010;18(1):522. Abstract 53.
Mueller et al., In Vivo Allele Specific Knockdown of Mutant Alpha-1 Antitrypsin Using Recombinant AAV Delivered shRNA. Molecular Therapy May 2009;17(1):S313. Abstract 817.
Mueller et al., Sustained miRNA-mediated knockdown of mutant AAT with simultaneous augmentation of wild-type AAT has minimal effect on global liver miRNA profiles. Mol Ther. Mar. 2012;20(3):590-600. Epub Jan. 17, 2012.
Mueller et al., The pros and cons of immunomodulatory IL-10 gene therapy with recombinant AAV in a Cftr-/- -dependent allergy mouse model. Gene Ther. Feb. 2009;16(2):172-83. Epub Sep. 25, 2008.
Mueller et al., Using rAAV Delivered miRNAs to Knockdown Misfolded Human Alpha 1 Antitrypsin in a Transgenic Mouse Model. Molecular Therapy 2010;18(1):521. Abstract 51.
Nakabayashi et al., Growth of human hepatoma cells lines with differentiated functions in chemically defined medium. Cancer Res. Sep. 1982;42(9):3858-63.
O'Reilly et al., RNA interference-mediated suppression and replacement of human rhodopsin in vivo. Am J Hum Genet. Jul. 2007;81(1):127-35. Epub May 23, 2007.
Powell-Braxton et al., A mouse model of human familial hypercholesterolemia: markedly elevated low density lipoprotein cholesterol levels and severe atherosclerosis on a low-fat chow diet. Nat Med. Aug. 1998;4(8):934-8. Erratum in: Nat Med Oct. 1998;4(10):1200.
Rayner et al., MiR-33 contributes to the regulation of cholesterol homeostasis. Science. Jun. 18, 2010;328(5985):1570-3. doi: 10.1126/science.1189862. Epub May 13, 2010.
Roy et al., Characterization of a family of chimpanzee adenoviruses and development of molecular clones for gene transfer vectors. Hum Gene Ther. May 2004;15(5):519-30.
Scallan et al., Human immunoglobulin inhibits liver transduction by AAV vectors at low AAV2 neutralizing titers in SCID mice. Blood. Mar. 1, 2006;107(5):1810-7. Epub Oct. 25, 2005.
Schnepp et al., Characterization of adeno-associated virus genomes isolated from human tissues. J Virol. Dec. 2005;79(23):14793-803.
Seiler et al., Adeno-associated virus types 5 and 6 use distinct receptors for cell entry. Hum Gene Ther. Jan. 2006;17(1):10-9.
Sen et al., Micromanaging vascular biology: tiny microRNAs play big band. J Vasc Res. 2009;46(6):527-40. doi: 10.1159/000226221. Epub Jun. 30, 2009.
Song et al., Intramuscular administration of recombinant adeno-associated virus 2 alpha-1 antitrypsin (rAAV-SERPINA1) vectors in a nonhuman primate model: safety and immunologic aspects. Mol Ther. Sep. 2002;6(3):329-35.
Soutar et al., Mechanisms of disease: genetic causes of familial hypercholesterolemia. Nat Clin Pract Cardiovasc Med. Apr. 2007;4(4):214-25.
Tannous, Gaussia luciferase reporter assay for monitoring biological processes in culture and in vivo. Nat Protoc. 2009;4(4):582-91. doi: 10.1038/nprot.2009.28.
Tokumaru et al., let-7 regulates Dicer expression and constitutes a negative feedback loop. Carcinogenesis. Nov. 2008;29(11):2073-7. doi: 10.1093/carcin/bgn187. Epub Aug. 11, 2008.
Tomar et al., Use of adeno-associated viral vector for delivery of small interfering RNA. Oncogene. Aug. 28, 2003;22(36):5712-5.
Tsai et al., MicroRNA-122, a tumor suppressor microRNA that regulates intrahepatic metastasis of hepatocellular carcinoma. Hepatology. May 2009;49(5):1571-82. doi: 10.1002/hep.22806.
Vandenberghe et al., Heparin binding directs activation of T cells against adeno-associated virus serotype 2 capsid. Nat Med. Aug. 2006;12(8):967-71. Epub Jul. 16, 2006.

(56) References Cited

OTHER PUBLICATIONS

Vandenberghe et al., Tailoring the AAV vector capsid for gene therapy. Gene Ther. Mar. 2009;16(3):311-9. Epub Dec. 4, 2008.

Virella-Lowell et al., Enhancing rAAV vector expression in the lung. J Gene Med. Jul. 2005;7(7):842-50.

Waldman et al., Applications of microRNA in cancer: Exploring the advantages of miRNA. Clin Transl Sci. Jun. 2009;2(3):248-9. doi: 10.1111/j.1752-8062.2009.00110.x.

Wang et al., Sustained correction of disease in naive and AAV2-pretreated hemophilia B dogs: AAV2/8-mediated, liver-directed gene therapy. Blood. Apr. 15, 2005;105(8):3079-86. Epub Jan. 6, 2005.

Wu et al., Alpha2,3 and alpha2,6 N-linked sialic acids facilitate efficient binding and transduction by adeno-associated virus types 1 and 6. J Virol. Sep. 2006;80(18):9093-103.

Wu et al., Nerve injection of viral vectors efficiently transfers transgenes into motor neurons and delivers RNAi therapy against ALS. Antioxid Redox Signal. Jul. 2009;11(7):1523-34.

Xie et al., Characterization of positioning effect of pol III-shRNA transcription unit in scAAV vector genome on the packaging efficiency and functionality of shRNA silencing. Meeting Abstract: 13th Annual Meeting of the American Society of Gene Therapy. May 19-22, 2010:S262. Abstract 671.

Xie et al., Isolation of transcriptionally active novel AAV capsid sequences from chimpanzee tissues for vector development. Meeting Abstract: 12th Annual Meeting of the American Society of Gene Therapy. May 1, 2009. Abstract 91.

Xie et al., MicroRNA regulated tissue specific transduction by rAAV vector. Molecular Therapy. May 2009;17(1): 5279. Abstract 732.

Xie et al., rAAV-mediated delivery of micro RNA scavengers leads to efficient and stable knockdown of cognate micro rnas, upregulation of their natural target genes and phenotypic changes in mice. Molecular Therapy. May 2010;18(1): S140. Abstract 362.

Yan et al., Unique biologic properties of recombinant AAV1 transduction in polarized human airway epithelia. J Biol Chem. Oct. 6, 2006;281(40):29684-92. Epub Aug. 9, 2006.

Yang et al., The muscle-specific microRNA miR-1 regulates cardiac arrhythmogenic potential by targeting GJA1 and KCNJ2. Nat Med. Apr. 2007;13(4):486-91. Epub Apr. 1, 2007. Erratum in: Nat Med. Dec. 2011;17(12):1693.

Yu et al., let-7 regulates self renewal and tumorigenicity of breast cancer cells. Cell. Dec. 14, 2007;131(6):1109-23.

Zabner et al., Adeno-associated virus type 5 (AAV5) but not AAV2 binds to the apical surfaces of airway epithelia and facilitates gene transfer. J Virol. Apr. 2000;74(8):3852-8.

Zhang et al., Characterization of 12 AAV vectors for intravascular delivery to target CNS and detarget non-CNS tissues by mirna regulation: implications in treatment of canavan disease. Molecular Therapy. May 2010;18(1): 5174. Abstract 450.

Zhong et al., Chimpanzee-derived novel natural variants of aav9: vector development and interrogation of correlations between capsid structure and vector biology. Molecular Therapy. May 2010;18(1): S24. Abstract 58.

Zolotukhin et al., Production and purification of serotype 1, 2, and 5 recombinant adeno-associated viral vectors. Methods. Oct. 2002;28(2):158-67.

* cited by examiner

| EPITOPE 2: PADVFMVPQYGYLTL | |
|---|---|
| | (369) 369  380 |
| AAV1 (367) | PADVFMIPQYGYLTLN |
| AAV2 (366) | PADVFMVPQYGYLTLN |
| AAV3 (366) | PADVFMVPQYGYLTLN |
| AAV4 (357) | PNDVFMVPQYGYLTLN |
| AAV5 (357) | PPQVFTLPQYGYATLN |
| AAV6 (367) | PADVFMIPQYGYLTLN |
| AAV7 (368) | PADVFMIPQYGYLTLN |
| AAV8 (369) | PADVFMIPQYGYLTLN |
| AAV9 (368) | PADVFMVPQYGYLTLN |
| ClV-R7 (368) | PADVFMIPQYGYLTLN |
| ClG-F1 (368) | PADVFTIPQYGYLTLN |

| EPITOPE 3: GNNFTFSYTFEDVPF | |
|---|---|
| | (412) 412  420 |
| AAV1 (407) | GNNFTFSYTFEEVPFH |
| AAV2 (406) | GNNFTFSYTFEDVPFH |
| AAV3 (406) | GNNFQFSYTFEDVPFH |
| AAV4 (400) | GNNFEITYSFEKVPFH |
| AAV5 (399) | GNNFEFTYNFEEVPFH |
| AAV6 (407) | GNNFTFSYTFEDVPFH |
| AAV7 (408) | GNNFEFSYTFEDVPFH |
| AAV8 (409) | GNNFQFTYTFEDVPFH |
| AAV9 (408) | GNNFQFSYEFNVPFH |
| ClV-R7 (408) | GNNFQFSVEFENVPFH |
| ClG-F1 (408) | GNNFQFSVEFENVPFH |
| ClG-F3 (408) | GNNFQSSVEFENVPFH |

| EPITOPE 4: SADNNNSEY | | |
|---|---|---|
| | (499) 499 | 510 |
| AAV1 (493) | KTDN---- | NNSNFT |
| AAV2 (492) | SADN---- | NNSEYS |
| AAV3 (493) | ANDN---- | NNSNFP |
| AAV4 (487) | ANQNYKIPATGSDSI | |
| AAV5 (479) | SGVN---- | RASVSA |
| AAV6 (493) | KTDN---- | NNSNFT |
| AAV7 (495) | LDQN---- | NNSNFA |
| AAV7 (495) | TGQN---- | NNSNFA |
| AAV9 (493) | VTQN---- | NNSEFA |
| ClV-R7 (493) | VTQN---- | NNSEFA |
| ClG-F1 (493) | VTQN---- | NNSEFA |
| ClG-F3 (493) | VTQN---- | NNSEFA |
| ClG-F7 (493) | VTQN---- | NNSEFA |
| ClG-F2 (493) | VTQN---- | NNSEFA |
| ClV-R9 (493) | VTQN---- | NNSEFA |
| ClG-F4 (493) | VTQN---- | NNSEFA |
| CBr-E6 (492) | VTQN---- | NNSEFA |
| CSp-1 (493) | VTQN---- | NNSEFA |
| CSp-3 (493) | VTRN---- | NNSEFA |

AAV'S AND USES THEREOF

RELATED APPLICATIONS

This application is a national stage filing under 35 U.S.C. §371 of international application PCT/US2010/032158, filed Apr. 23, 2010, entitled "NOVEL AAV'S AND USES THEREOF" and claims priority under 35 U.S.C. §119(e) to U.S. Provisional Application Ser. No. 61/182,084, entitled "NOVEL AAV'S AND USES THEREOF" filed on May 28, 2009, which is herein incorporated by reference in its entirety.

FIELD OF THE INVENTION

The invention in some aspects relates to isolated nucleic acids, compositions, and kits useful for identifying adeno-associated viruses in cells. In some aspects, the invention provides novel AAVs and methods of use thereof as well as related kits.

BACKGROUND OF INVENTION

Adenoassociated Virus (AAV) is a small and helper dependent virus. It was discovered in 1960s as a contaminant in adenovirus (a cold causing virus) preparations. Its growth in cells is dependent on the presence of adenovirus and, therefore, it was named as adeno-associated virus. Before 2002, a total of 6 serotypes of AAVs were identified, including the serotype 2 which was the first AAV developed as vector for gene transfer applications and the one used in the recent break through eye gene therapy trials. In the earlier attempts to develop AAV as gene transfer vehicle, prototype AAV vector based on serotype 2 effectively served as a proof-of-concept showcase and accomplished non-toxic and stable gene transfer in murine and large animal models in different target tissues. For instance an 8 year, stable vision improvement was observed in a dog model of LCA after a single injection and a 9 year, stable gene expression in Macaque muscle was achieved. However, these proof-of-concept studies also revealed a significant shortcoming which is a poor gene transfer efficiency in major target tissues.

Methods for discovering novel AAVs have been largely focused on isolating DNA sequences for AAV capsids, which relate to the tissue targeting capacity of the virus. To date, the principal methods employed for identifying novel AAV take advantage of the latency of AAV proviral DNA genomes and focus on rescuing persisted viral genomic DNA. The major challenge in DNA-targeted AAV isolation is that the abundance of persisted AAV genomes is often very low in most of tissues particularly in human tissues, which makes AAV rescue unachievable in many cases.

SUMMARY OF INVENTION

The invention in some aspects relates to novel AAVs for gene therapy applications. In some aspects the invention relates to AAVs having distinct tissue targeting capabilities (e.g., tissue tropisms), which achieve stable and nontoxic gene transfer at the efficiencies similar to those of adenovirus vectors. In some aspects, the invention relates to isolated nucleic acids (e.g., primers, transgenes), composition and kits useful in the methods for identifying novel AAVs.

The invention in some aspects provides an isolated nucleic acid comprising a sequence selected from the group consisting of: SEQ ID NO: 13-86, which encodes an AAV capsid protein. In some embodiments, a fragment of the isolated nucleic acid is provided. In certain embodiments, the fragment of the isolated nucleic acid does not encode a peptide that is identical to a sequence of any one of SEQ ID NOs: 177-183.

The invention in some aspects provides an isolated AAV capsid protein comprising an amino acid sequence selected from the group consisting of: SEQ ID NOs: 87-160 and 171-176. In some embodiments, the isolated AAV capsid protein comprises a sequence selected from the group consisting of: SEQ ID NOs: 147, 148, and 152, wherein an amino acid of the sequence that is not identical to a corresponding amino acid of the sequence set forth as SEQ ID NOs: 179 is replaced with a conservative substitution. In some embodiments, the isolated AAV capsid protein comprises a sequence selected from the group consisting of: SEQ ID NOs: 87-128 and 171-178, wherein an amino acid of the sequence that is not identical to a corresponding amino acid of the sequence set forth as SEQ ID NO: 180 is replaced with a conservative substitution. In some embodiments, the isolated AAV capsid protein comprises a sequence set forth as SEQ ID NO: 156, wherein an amino acid of the sequence that is not identical to a corresponding amino acid of the sequence set forth as SEQ ID NO: 181 is replaced with a conservative substitution. In some embodiments, the isolated AAV capsid protein comprises a sequence selected from the group consisting of: SEQ ID NOs: 149-151, 153-155, and 157-159, wherein an amino acid of the sequence that is not identical to a corresponding amino acid of the sequence set forth as SEQ ID NO: 182 is replaced with a conservative substitution. In some embodiments, the isolated AAV capsid protein comprises a sequence set forth as SEQ ID NO: 134, wherein an amino acid of the sequence that is not identical to a corresponding amino acid of the sequence set forth as SEQ ID NO: 183 is replaced with a conservative substitution. In some embodiments, the isolated AAV capsid protein comprises a sequence selected from the group consisting of: SEQ ID NOs: 129-133 and 135-146, wherein an amino acid of the sequence that is not identical to a corresponding amino acid of the sequence set forth as SEQ ID NO: 184 is replaced with a conservative substitution. In some embodiments, the isolated AAV capsid protein comprises a sequence set forth as SEQ ID NO: 160, wherein an amino acid of the sequence that is not identical to a corresponding amino acid of the sequence set forth as SEQ ID NO: 185 is replaced with a conservative substitution. In certain embodiments, a peptide fragment of the isolated AAV capsid protein is provided. In one embodiment, the peptide fragment is not identical to a sequence of any one of SEQ ID NO: 179-185. In some embodiments, an isolated AAV capsid protein comprising the peptide fragment is provided.

In some embodiments, the isolated AAV capsid protein comprises a sequence set forth as SEQ ID NO: 179, wherein an amino acid of the sequence is replaced with a non-identical, corresponding amino acid of the sequence set forth as SEQ ID NOs: 147, 148, or 152. In some embodiments, the isolated AAV capsid protein comprises a sequence set forth as SEQ ID NO: 180, wherein an amino acid of the sequence is replaced with a non-identical, corresponding amino acid of the sequence set forth as any one of SEQ ID NOs: 87-128 and 171-176. In some embodiments, the isolated AAV capsid protein comprises a sequence set forth as SEQ ID NO: 181, wherein an amino acid of the sequence is replaced with a non-identical, corresponding amino acid of the sequence set forth as SEQ ID NO: 156. In some embodiments, the isolated AAV capsid protein comprises a sequence set forth as SEQ ID NO: 182, wherein an amino acid of the sequence is replaced with a non-identical, corresponding amino acid of the sequence set forth as any one of SEQ ID NOs: 149-151, 153-155, and 157-159. In some embodiments, the isolated AAV capsid protein comprises a sequence set forth as SEQ ID NO: 183, wherein an amino acid of the sequence is replaced with a non-identical, corresponding amino acid of the sequence set forth as SEQ ID NO: 134. In some embodiments, the isolated AAV capsid protein comprises a sequence set forth as SEQ ID NO: 184, wherein an amino acid of the sequence is replaced with a non-identical, corresponding amino acid of the sequence set forth as any one of SEQ ID NOs: 129-133 and 135-146. In some embodiments, the isolated AAV capsid protein comprises a sequence set forth as SEQ ID NO: 185, wherein an amino acid of the sequence is replaced with a non-identical, corresponding amino acid of the sequence set forth as SEQ ID NO: 160. In some embodiments, isolated nucleic acids encoding any of the foregoing isolated AAV caspid protein are provided.

In certain aspects of the invention, a composition is provided that comprises any of the foregoing isolated AAV capsid proteins. In some embodiments, the composition further comprises a pharmaceutically acceptable carrier. In some embodiments a composition of one or more of the isolated AAV capsid proteins of the invention and a physiologically compatible carrier is provided.

In certain aspects of the invention, a recombinant AAV (rAAV) is provided that comprises any of the foregoing isolated AAV capsid proteins. In some embodiments, a composition comprising the rAAV is provided. In certain embodiments, the composition comprising the rAAV further comprises a pharmaceutically acceptable carrier. A recombinant AAV is also provided, wherein the recombinant AAV includes one or more of the isolated AAV capsid proteins of the invention.

In some aspects of the invention, a host cell is provided that contains a nucleic acid that comprises a coding sequence selected from the group consisting of: SEQ ID NO: 13-86 that is operably linked to a promoter. In some embodiments, a composition comprising the host cell and a sterile cell culture medium is provided. In some embodiments, a composition comprising the host cell and a cryopreservative is provided.

According to some aspects of the invention, a method for delivering a transgene to a subject is provided. In some embodiments, the method comprises administering any of the foregoing rAAVs to a subject, wherein the rAAV comprises at least one transgene, and wherein the rAAV infects cells of a target tissue of the subject. In some embodiments, subject is selected from a mouse, a rat, a rabbit, a dog, a cat, a sheep, a pig, and a non-human primate. In one embodiment, the subject is a human. In some embodiments, the at least one transgene is a protein coding gene. In certain embodiments, the at least one transgene encodes a small interfering nucleic acid. In certain embodiments, the small interfering nucleic acid is a miRNA. In certain embodiments, the small interfering nucleic acid is a miRNA sponge or TuD RNA that inhibits the activity of at least one miRNA in the subject. In certain embodiments, the miRNA is expressed in a cell of the target tissue In certain embodiments, the target tissue is skeletal muscle, heart, liver, pancreas, brain or lung. In some embodiments, the transgene expresses a transcript that comprises at least one binding site for a miRNA, wherein the miRNA inhibits activity of the transgene, in a tissue other than the target tissue, by hybridizing to the binding site. In certain embodiments, the rAAV is administered to the subject intravenously, transdermally, intraocularly, intrathecally, intracerebrally, orally, intramuscularly, subcutaneously, intranasally, or by inhalation.

According to some aspects of the invention, a method for generating a somatic transgenic animal model is provided. In some embodiments, the method comprises administering any of the foregoing rAAVs to a non-human animal, wherein the rAAV comprises at least one transgene, and wherein the rAAV infects cells of a target tissue of the non-human animal. In some embodiments, the at least one transgene is a protein coding gene. In certain embodiments, the at least one transgene encodes a small interfering nucleic acid. In some embodiments, the at least one transgene encodes a reporter molecule. In certain embodiments, the small interfering nucleic acid is a miRNA. In certain embodiments, the small interfering nucleic acid is a miRNA sponge or TuD RNA that inhibits the activity of at least one miRNA in the animal. In certain embodiments, the miRNA is expressed in a cell of the target tissue In certain embodiments, the target tissue is skeletal muscle, heart, liver, pancreas, brain or lung. In some embodiments, the transgene expresses a transcript that comprises at least one binding site for a miRNA, wherein the miRNA inhibits activity of the transgene, in a tissue other than the target tissue, by hybridizing to the binding site. According to some aspects of the invention, methods are provided for generating a somatic transgenic animal model that comprise administering any of the foregoing rAAVs to a non-human animal, wherein the rAAV comprises at least one transgene, wherein the transgene expresses a transcript that comprises at least one binding site for a miRNA, wherein the miRNA inhibits activity of the transgene, in a tissue other than a target tissue, by hybridizing to the binding site of the transcript. In some embodiments, the transgene comprises a tissue specific promoter or inducible promoter. In certain embodiments, the tissue specific promoter is a liver-specific thyroxin binding globulin (TBG) promoter, a insulin promoter, a glucagon promoter, a somatostatin promoter, a pancreatic polypeptide (PPY) promoter, a synapsin-1 (Syn) promoter, a creatine kinase (MCK) promoter, a mammalian desmin (DES) promoter, a α-myosin heavy chain (a-MHC) promoter, or a cardiac Troponin T (cTnT) promoter. In certain embodiments, the rAAV is administered to the animal intravenously, transdermally, intraocularly, intrathecally, orally, intramuscularly, subcutaneously, intranasally, or by inhalation. According to some aspects of the invention, a somatic transgenic animal model is provided that is produced by any of the foregoing methods.

In other aspects of the invention, a kit for producing a rAAV is provided. In some embodiments, the kit comprises a container housing an isolated nucleic acid having a sequence of any one of SEQ ID NO: 13-86. In some embodiments, the kit further comprises instructions for producing the rAAV. In some embodiments, the kit further comprises at least one container housing a recombinant AAV vector, wherein the recombinant AAV vector comprises a transgene.

In other aspects of the invention, a kit is provided that comprises a container housing a recombinant AAV having any of the foregoing isolated AAV capsid proteins. In some embodiments, the container of the kit is a syringe.

In other aspects, the invention relates to the use of AAV based vectors as vehicles for, delivery of genes, therapeutic, prophylactic, and research purposes as well as the development of somatic transgenic animal models. In some aspects, the invention relates to AAV serotypes that have demonstrated distinct tissue/cell type tropism and can achieve stable somatic gene transfer in animal tissues at levels similar to those of adenoviral vectors (e.g., up to 100% in vivo tissue transduction depending upon target tissue and vector dose) in the absence of vector related toxicology. In other aspects, the invention relates to AAV serotypes having liver, heart, skeletal muscle, brain and pancreas tissue targeting capabilities. These tissues are associated with a broad spectrum of human diseases including a variety of metabolic, cardiovascular and diabetic diseases. In some embodiments the rAAV includes at least one transgene. The transgene may be one which causes a pathological state. In some embodiments, the transgene encoding a protein that treats a pathological state.

In another aspect the novel AAVs of the invention may be used in a method for delivering a transgene to a subject. The method is performed by administering a rAAV of the invention to a subject, wherein the rAAV comprises at least one transgene. In some embodiments the rAAV targets a predetermined tissue of the subject.

In another aspect the AAVs of the invention may be used in a method for generating a somatic transgenic animal model. The method is performed by administering a rAAV of the invention to an animal, wherein the rAAV comprises at least one transgene, wherein the transgene causes a pathological state, and wherein the rAAV targets a predetermined tissue of the animal.

In one embodiment the rAAV has a AAV capsid having an amino acid sequence selected from the group consisting of: SEQ ID NOs: 87-160 and 171-178.

The transgene may express a number of genes including cancer related genes, pro-apoptotic genes and apoptosis-related genes. In some embodiments the transgene expresses a small interfering nucleic acid capable of inhibiting expression of a cancer related gene. In other embodiments the transgene expresses a small interfering nucleic acid capable of inhibiting expression of a apoptosis-related gene. The small interfering nucleic acid in other embodiments is a miRNA or shRNA. According to other embodiments the transgene expresses a toxin, optionally wherein the toxin is DTA. In other embodiments the transgene expresses a reporter gene which is optionally a reporter enzyme, such as Beta-Galactosidase or a Fluorescent protein, such as GFP.

The transgene may express a miRNA. In other embodiments the transgene expresses a miRNA sponge, wherein miRNA sponge inhibits the activity of one or more miRNAs in the animal. The miRNA may be an endogenous miRNA or it may be expressed in a cell of a heart, liver, skeletal muscle, brain or pancreas tissue, in some embodiments.

In one embodiment the target tissue of an AAV is gonad, diaphragm, heart, stomach, liver, spleen, pancreas, or kidney. The rAAV may transduce many different types of tissue, such as muscle fibers, squamous epithelial cells, renal proximal or distal convoluted tubular cells, mucosa gland cells, blood vessel endothelial cells, or smooth muscle cells.

In some embodiments the rAAV is administered at a dose of $10^{10}$, $10^{11}$, $10^{12}$, $10^{13}$, $10^{14}$, or $10^{15}$ genome copies per subject. In some embodiments the rAAV is administered at a dose of $10^{10}$, $10^{11}$, $10^{12}$, $10^{13}$, or $10^{14}$ genome copies per kg. The rAAV may be administered by any route. For instance it may be administered intravenously (e.g., by portal vein injection) in some embodiments.

In some embodiments the transgene includes a tissue specific promoter such as a liver-specific thyroxin binding globulin (TBG) promoter, a insulin promoter, a glucagon promoter, a somatostatin promoter, a pancreatic polypeptide (PPY) promoter, a synapsin-1 (Syn) promoter, a creatine kinase (MCK) promoter, a mammalian desmin (DES) promoter, a α-myosin heavy chain (a-MHC) promoter, or a cardiac Troponin T (cTnT) promoter.

The somatic transgenic animal model may be a mammal, such as a mouse, a rat, a rabbit, a dog, a cat, a sheep, a pig, a non-human primate.

In some embodiments a putative therapeutic agent may be administered to the somatic transgenic animal model to determine the effect of the putative therapeutic agent on the pathological state in the animal.

In another aspect the invention is a somatic transgenic animal produced by the methods described herein.

A kit for producing a rAAV that generates a somatic transgenic animal having a pathological state in a predetermined tissue is provided according to another aspect of the invention. The kit includes at least one container housing a recombinant AAV vector, at least one container housing a rAAV packaging component, and instructions for constructing and packaging the recombinant AAV.

The rAAV packaging component may include a host cell expressing at least one rep gene and/or at least one cap gene. In some embodiments the host cell is a 293 cell. In other embodiments the host cell expresses at least one helper virus gene product that affects the production of rAAV containing the recombinant AAV vector. The at least one cap gene may encode a capsid protein from an AAV serotype that targets the predetermined tissue.

In other embodiments a rAAV packaging component includes a helper virus optionally wherein the helper virus is an adenovirus or a herpes virus.

The rAAV vector and components therein may include any of the elements described herein. For instance, in some embodiments the rAAV vector comprises a transgene, such as any of the transgenes described herein. In some embodiments the transgene expresses a miRNA inhibitor (e.g., a miRNA sponge or TuD RNA), wherein miRNA inhibitor inhibits the activity of one or more miRNAs in the somatic transgenic animal.

Each of the limitations of the invention can encompass various embodiments of the invention. It is, therefore, anticipated that each of the limitations of the invention involving any one element or combinations of elements can be included in each aspect of the invention. This invention is not limited in its application to the details of construction and the arrangement of components set forth in the following description or illustrated in the drawings. The invention is capable of other embodiments and of being practiced or of being carried out in various ways.

BRIEF DESCRIPTION OF DRAWINGS

The accompanying drawings are not intended to be drawn to scale. In the drawings, each identical or nearly identical component that is illustrated in various figures is represented by a like numeral. For purposes of clarity, not every component may be labeled in every drawing. In the drawings:

FIG. 4 depicts an amino acid comparison among immunological epitopes of AAV cap protein. Sequences from Epitope 2 to AAV5 (357) correspond to SEQ ID NO: 186-190; sequences from AAV6 (367) to CLv-R7 (368) all correspond to SEQ ID NO: 187; sequence of CLg-F1 (368) corresponds to SEQ ID NO: 191; sequences from Epitope 3 to AAV5 (399) correspond to SEQ ID NO: 192-197; sequence of AAV6 (407) corresponds to SEQ ID NO: 194; sequences from AAV7 (408) to AAV9 (408) correspond to SEQ ID NO: 198-200; sequences of Clv-R7 (408) and Clg-F1 (408) both correspond to SEQ ID NO: 200; sequence of CLg-F3 (408) corresponds to SEQ ID NO: 201; sequences from Epitope 4 to AAV5 (479)

correspond to SEQ ID NO: 202 to 207; sequence of AAV6 (493) corresponds to SEQ ID NO: 203; sequences from AAV7 (495) to AAV9 (493) correspond to SEQ ID NO: 208-210; sequences from CLv-R7 (493) to CLv-R9 (493), CBr-E6 (492), and CSp-1 (493) all correspond to SEQ ID NO: 210; sequence of CLg-F4 (493) corresponds to SEQ ID NO: 211; and sequence of CSp-3 (493) corresponds to SEQ ID NO: 212.

Figure 1:
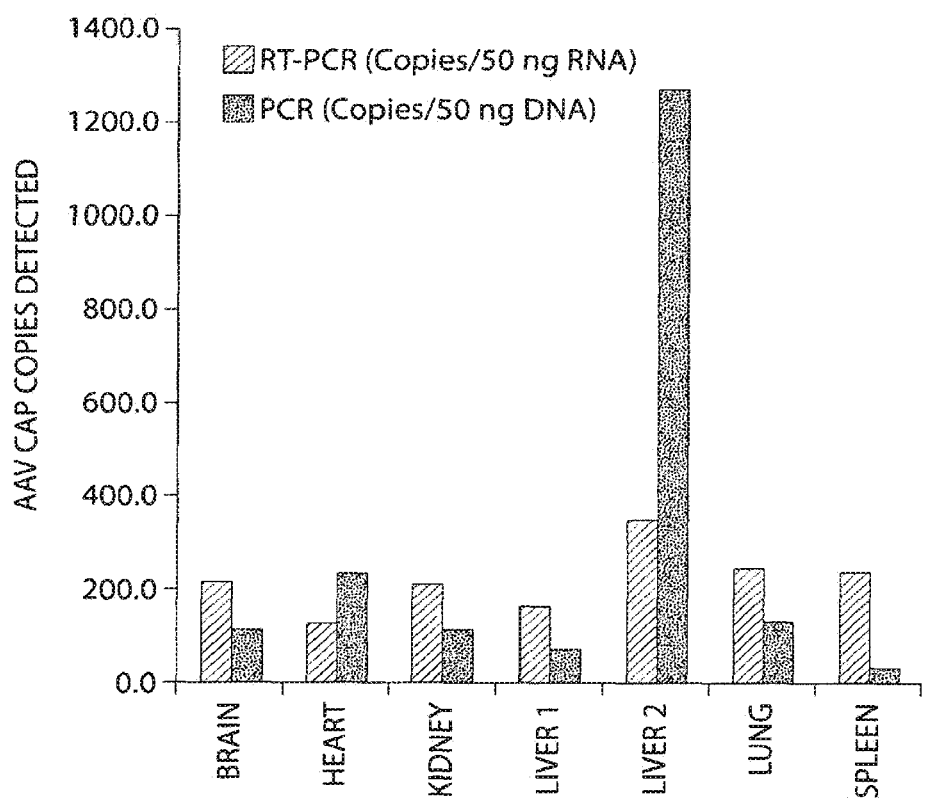
FIG. 1 depicts a quantification of the number of AAV Cap genes detected across various tissues via RT-PCR based detection of RNA Cap sequences or PCR based detection of DNA Cap sequences
Figure 2:
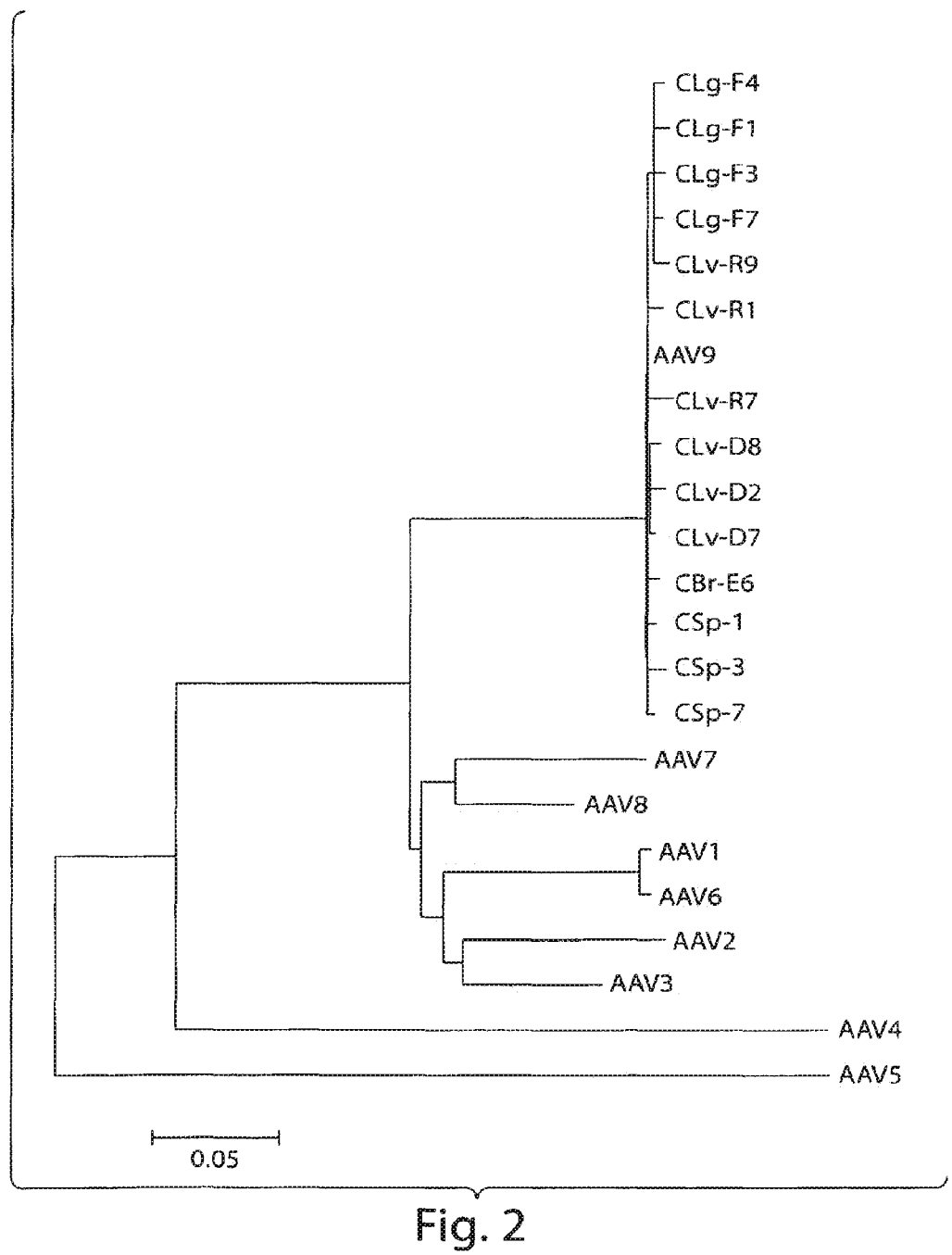
FIG. 2 depicts a dendrogram from a hierarchical cluster analysis of AAVs based on similarities of cap gene sequences. The dendrogram includes a large cluster of AAV9 variants.
Figure 3:
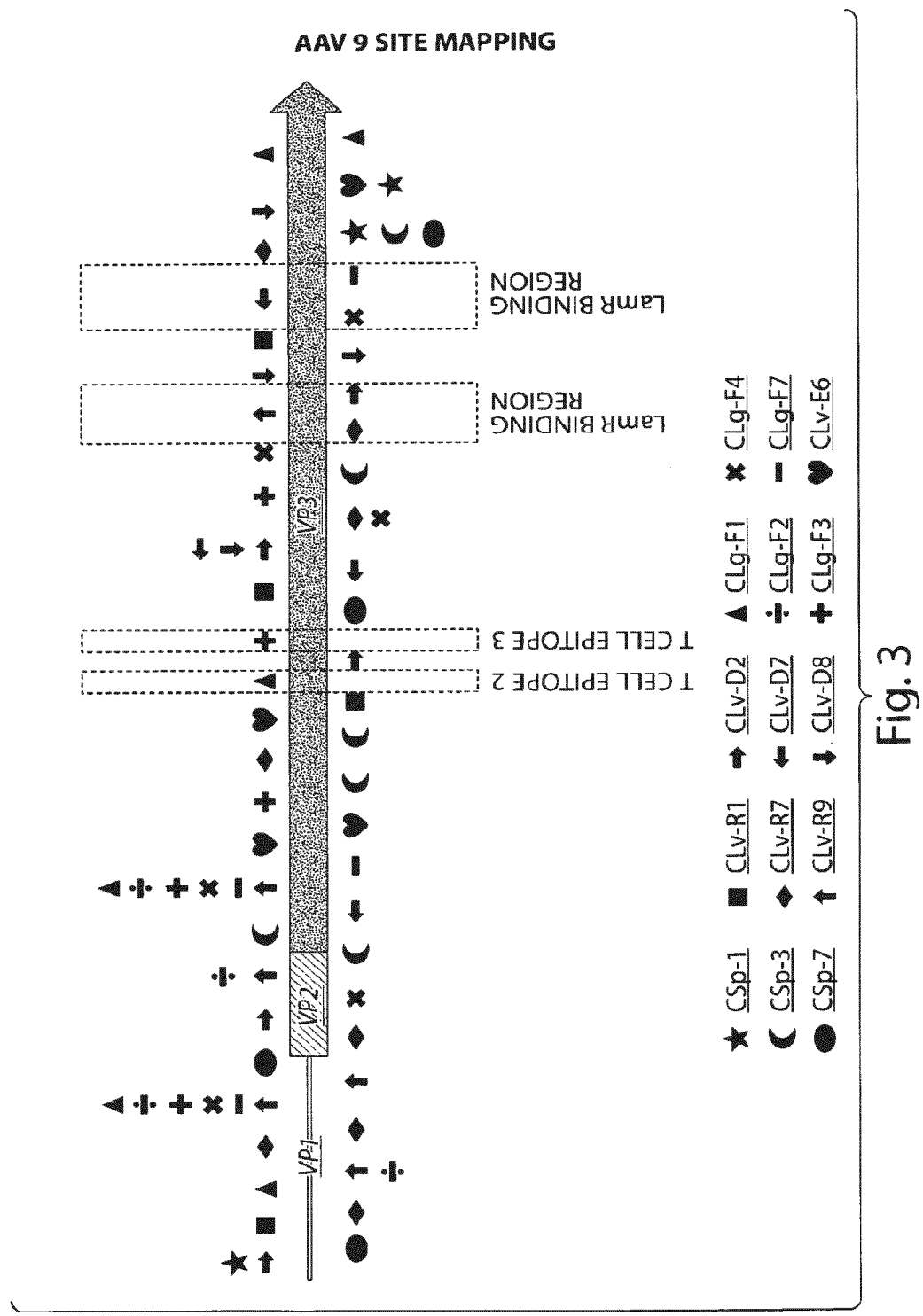
FIG. 3 is a schematic map of positions in AAV9 cap proteins of amino acid variations of the AAV9 variants.
Figure 5:
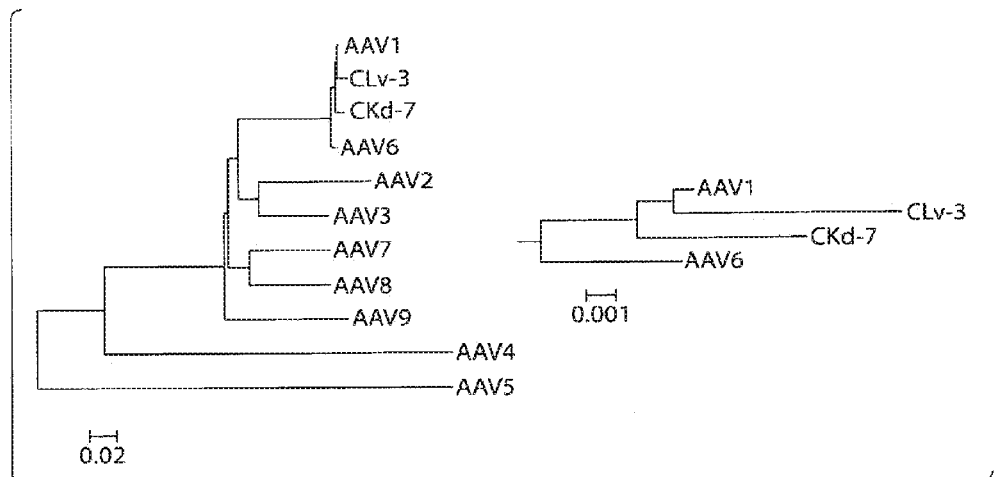

FIG. 5 depicts a dendrogram from a hierarchical cluster analysis of AAVs based on similarities of cap gene sequences. The dendrogram includes a cluster with two new AAV1 variants, which is expanded in the right panel, each having 4 amino acid differences from AAV1 cap protein.

Figure 6:
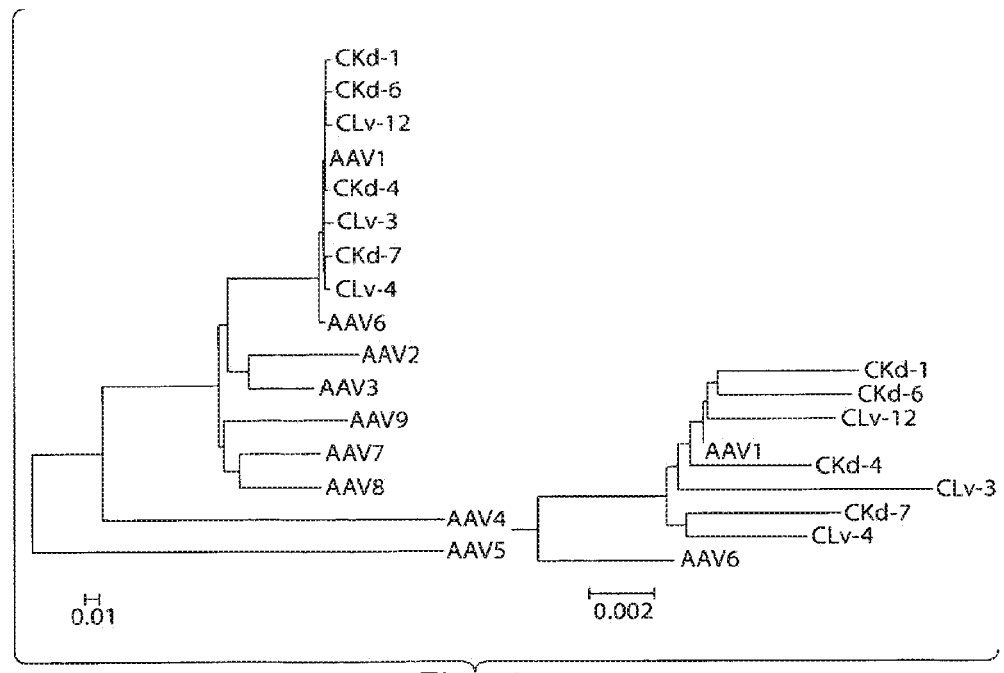

FIG. 6 depicts a dendrogram from a hierarchical cluster analysis of AAVs based on similarities of cap gene sequences. The dendrogram includes a cluster of AAV1 variants, which is expanded in the right panel. Ckd-7 and clv-3 have 4 amino acids different from AAV1 cap protein. Ckd-1, clv-4, ckd-4, ckd-6, and clv-12 have 3 amino acids different from AAV1 cap protein.

Figure 7:
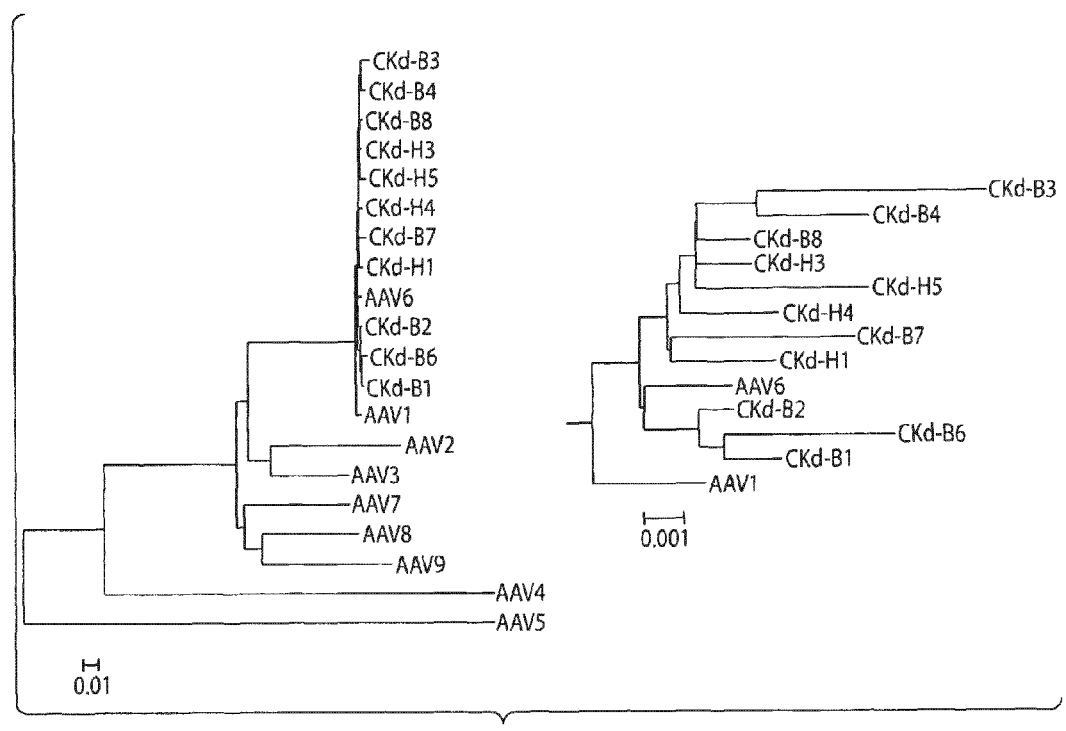

FIG. 7 depicts a dendrogram from a hierarchical cluster analysis of AAVs based on similarities of cap gene sequences. The dendrogram includes a cluster of AAV6 variants, including Ckd-B6, CKd-B1, Ckd-B3, Ckd-B8, Ckd-B4, Ckd-B7, Ckd-H1, Ckd-H4, Ckd-H5, Ckd-H3 and Ckd-B2. Except for Ckd-H3 and Ckd-B2 which have 3 a.a. different from AAV6 cap, all others have 4 a.a. different from AAV6 cap.

Figure 8:
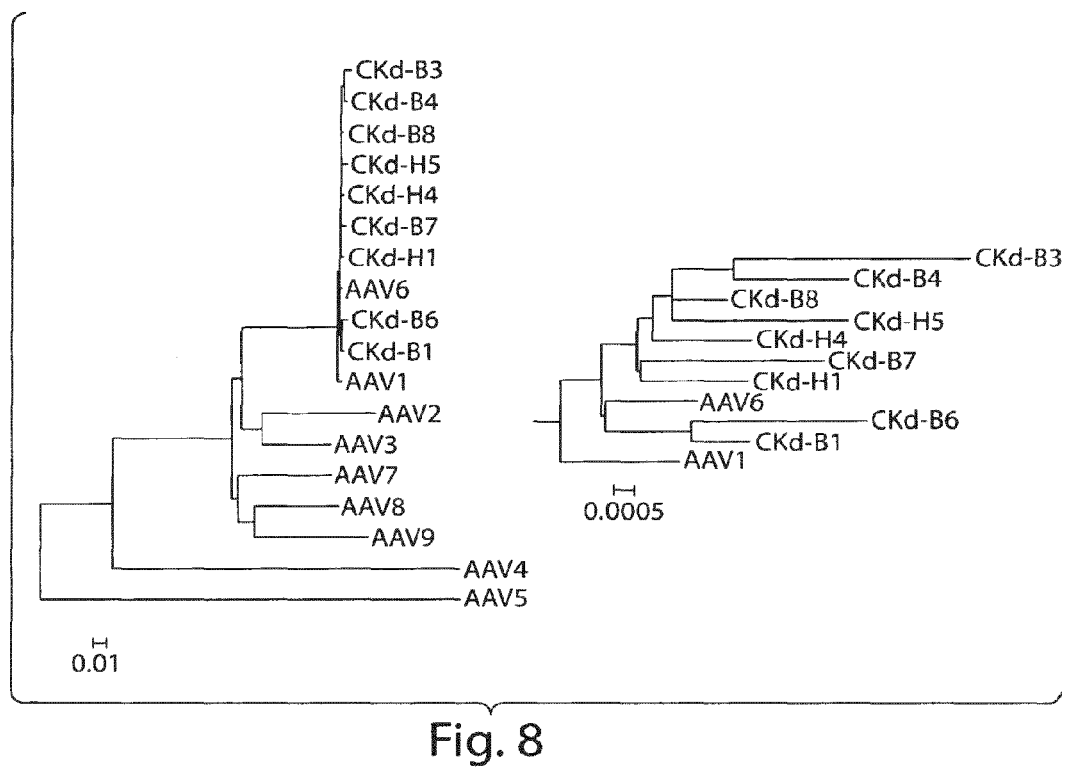

FIG. 8 depicts a dendrogram from a hierarchical cluster analysis of AAVs based on similarities of cap gene sequences. The dendrogram includes a cluster of AAV6 variants, including Ckd-B6, CKd-B1, Ckd-B3, Ckd-B8, Ckd-B4, Ckd-B7, Ckd-H1, Ckd-H4, Ckd-H5. All of these new AAVs have 4 a.a. different from AAV6 cap.

Figure 9A:
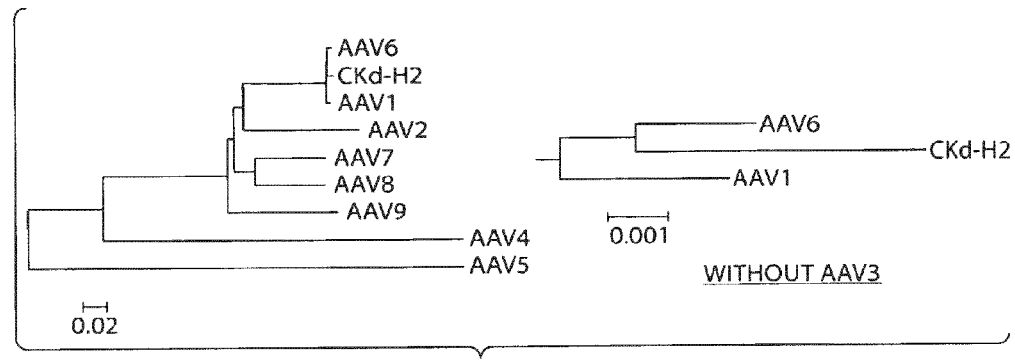
Figure 9B:
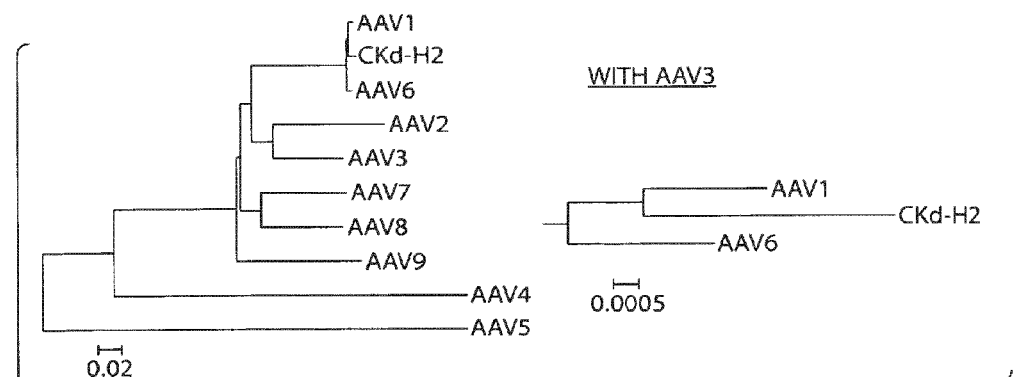

FIG. 9 depicts a dendrogram from a hierarchical cluster analysis of AAVs based on similarities of cap gene sequences. The most similar sequence in GenBank to CKd-H2 is AAV VRC-355. The latter was isolated form simian adenovirus isolates in ATCC and is AAV6-like in terms of identity but has some different biological properties (J Virol, 2006, 80:5082). CKd-H2 is similar to AAV1 and AAV6. When clustered with AAV1-9 excluding AAV3, Ckd-H2 appears in a cluster with AAV6. (FIG. 9A.) When clustered with AAV1-9 including AAV3, Ckd-H2 appears in a cluster with AAV6. (FIG. 9B.)

Figure 10:
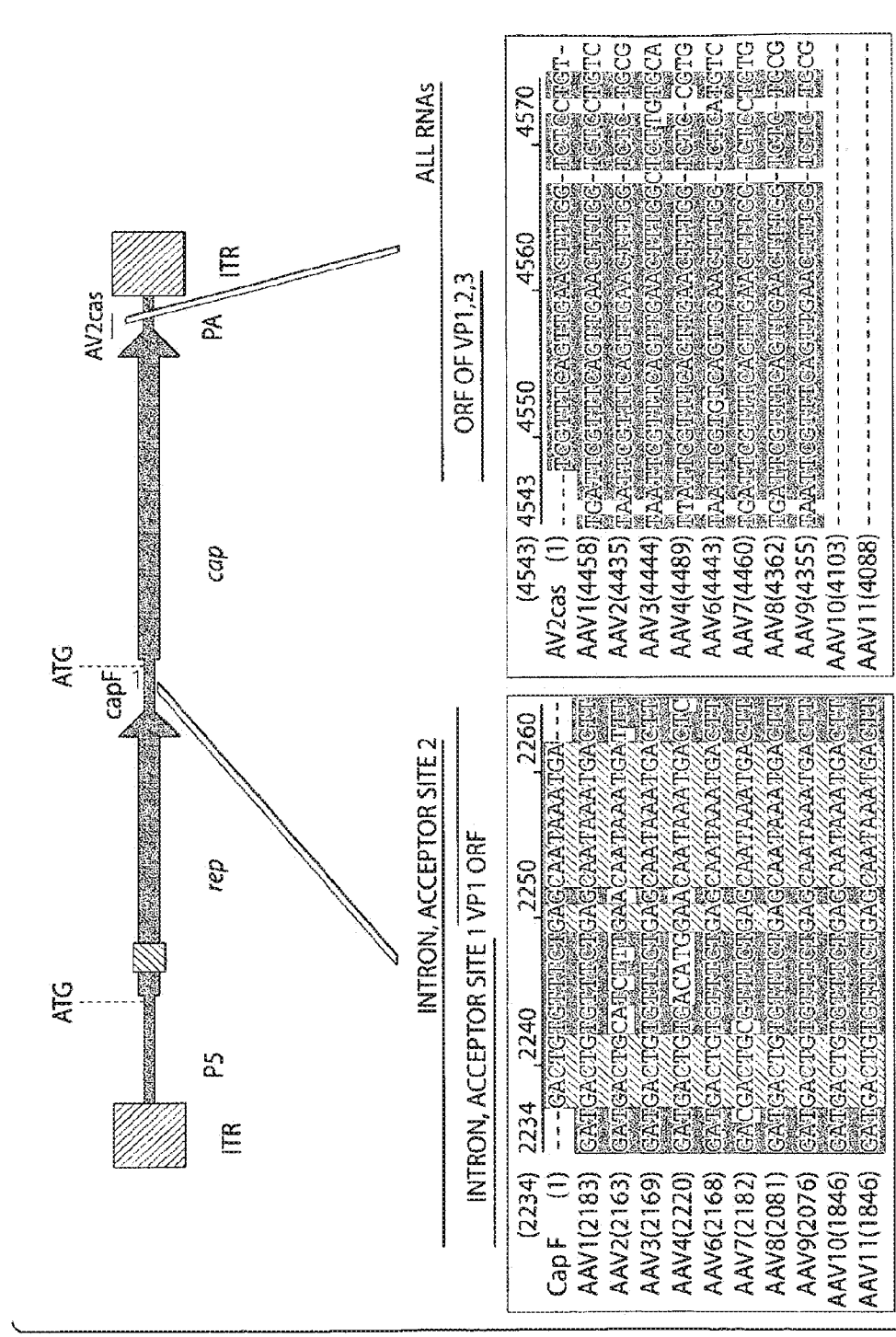

FIG. 10 depicts sequence alignments among AAV1-AAV11 with forward (CapF) and reverse (AV2 case) primers which are used together for RT-PCR based recovery of AAV cap coding sequences. Sequences from capF (1) to AAV2 (2163) correspond to SEQ ID NO: 213-215; sequences of AAV3(2169), AAV6(2168), and AAV8 (2081) to AAV11 (1846) all correspond to SEQ ID NO: 214; sequence of AAV4 (2220) corresponds to SEQ ID NO: 216; sequence of AAV7 (2182) corresponds to SEQ ID NO: 217; sequences of AAV2cas (1) to AAV8(4362) correspond to SEQ ID NO: 218-225; and sequence of AAV9(4355) corresponds to SEQ ID NO: 220.

Figure 11:
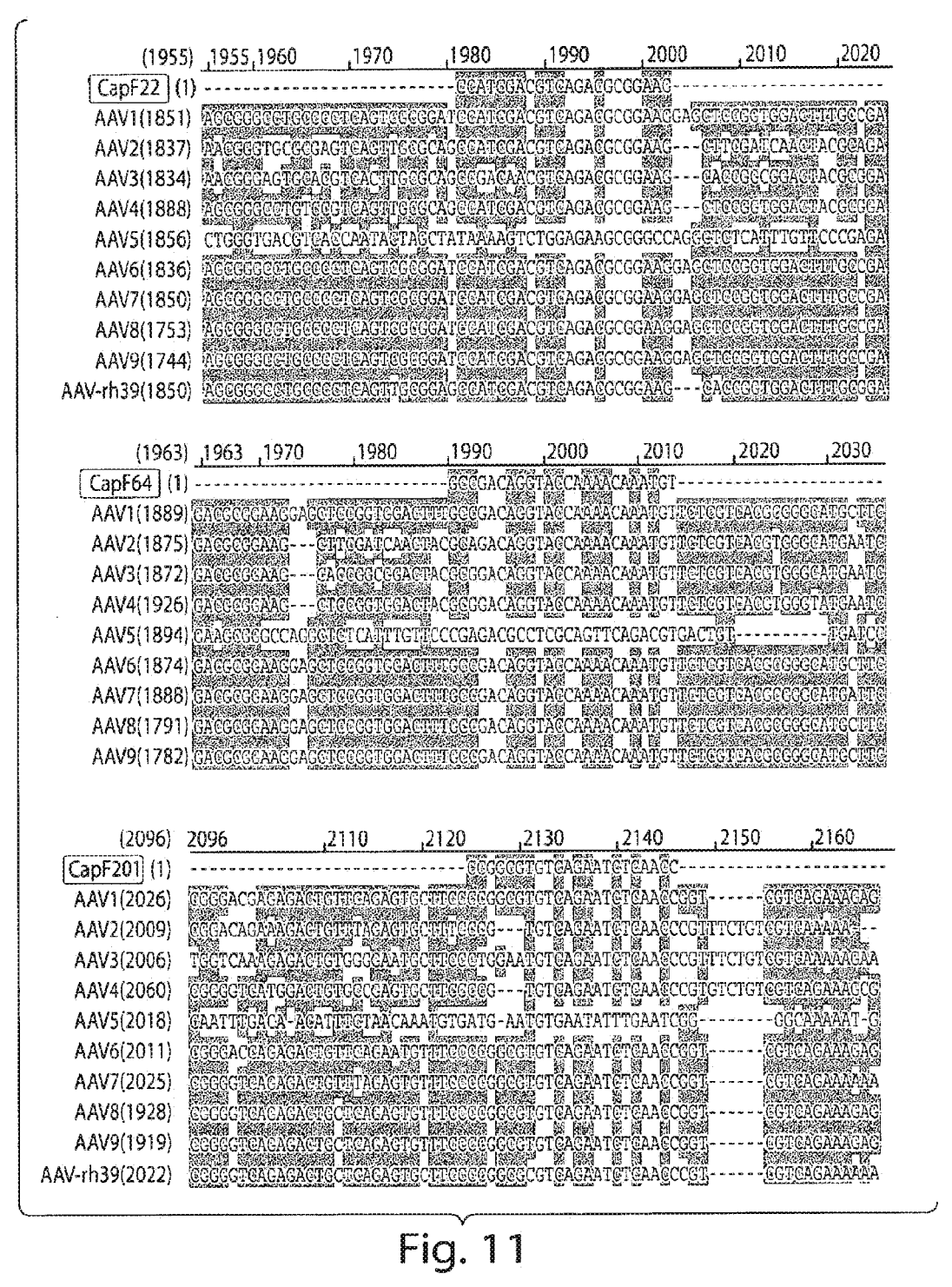

FIG. 11 depicts sequence alignments among various AAVs with three forward primers which are used together for RT-PCR based recovery of AAV cap coding sequences. Sequences from capF22 to AAV5(1856) correspond to SEQ ID NO: 226-231; sequences of AAV6(1836) to AAV9(1744) all correspond to SEQ ID NO: 227; sequence of AAV-rh39 (1850) to AAV5(1894) corresponds to SEQ ID NO: 232-238; sequence of AAV6(1874), AAV8(1791) and AAV9(1782) all correspond to SEQ ID NO: 234; sequence of AAV7(1888) corresponds to SEQ ID NO: 239; sequences of capF201 (1) to AAV8 (1928) correspond to SEQ ID NO: 240-248; sequence of AAV9 (1919) corresponds to SEQ ID NO: 248; and sequence of AAV-rh39 (2022) corresponds to SEQ ID NO: 249.

Figure 12A:
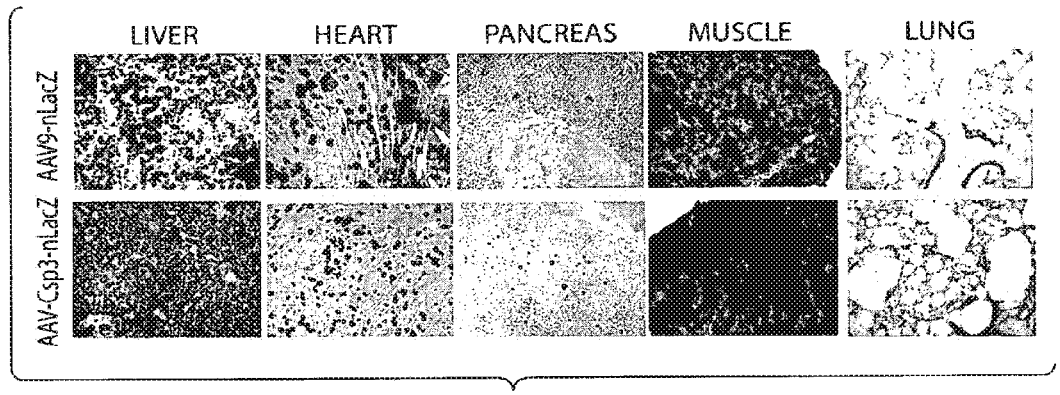
Figure 12B:
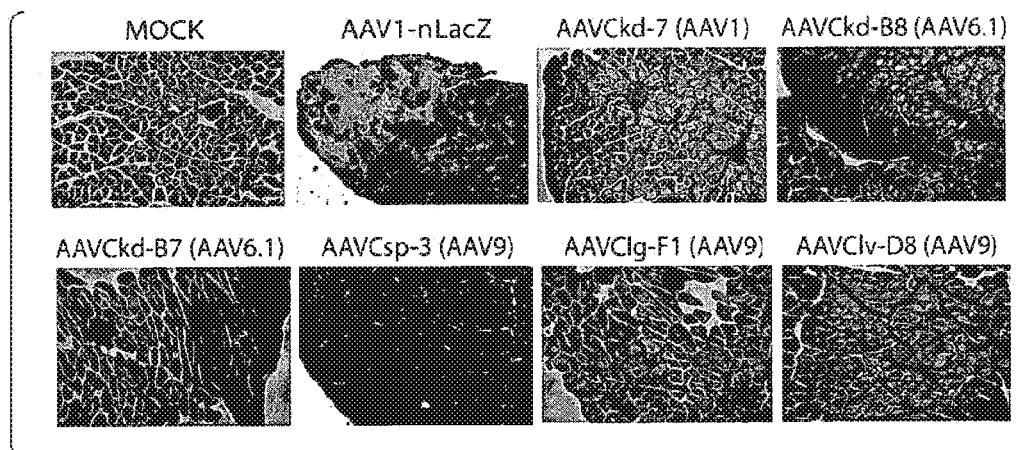

FIG. 12A depicts transduction efficiency of AAV9 and Csp-3 vectors in different organs. FIG. 12B depicts transduction efficient of AAV variants in skeletal muscle.

Figure 13:
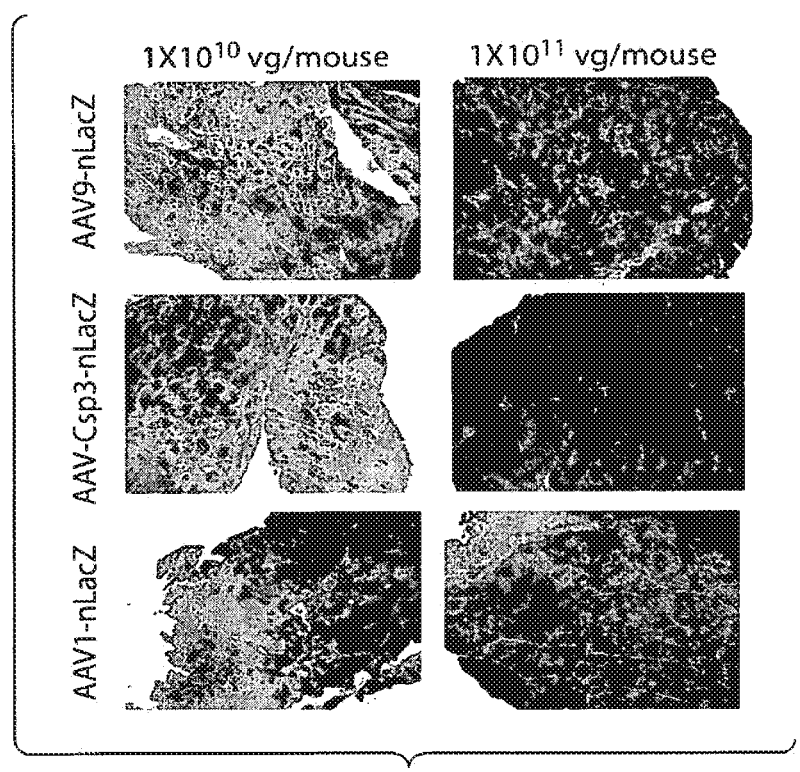

FIG. 13 depicts transduction efficiency of AAV variants in skeletal muscle at different doses.

Figure 14:
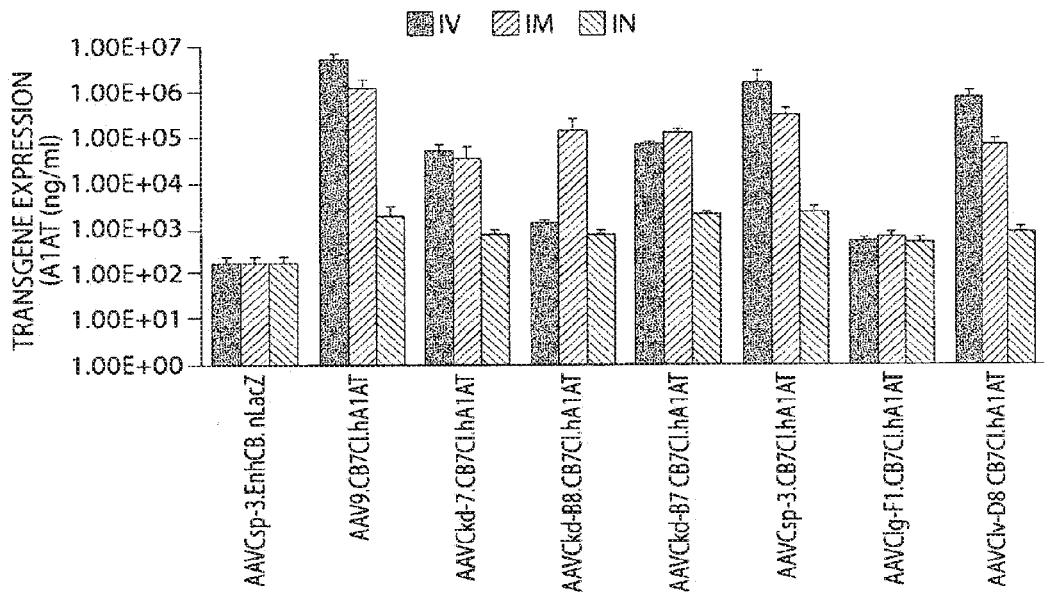

FIG. 14 depicts transduction efficiency of AAV variants by different routes of administration.

Figure 15:
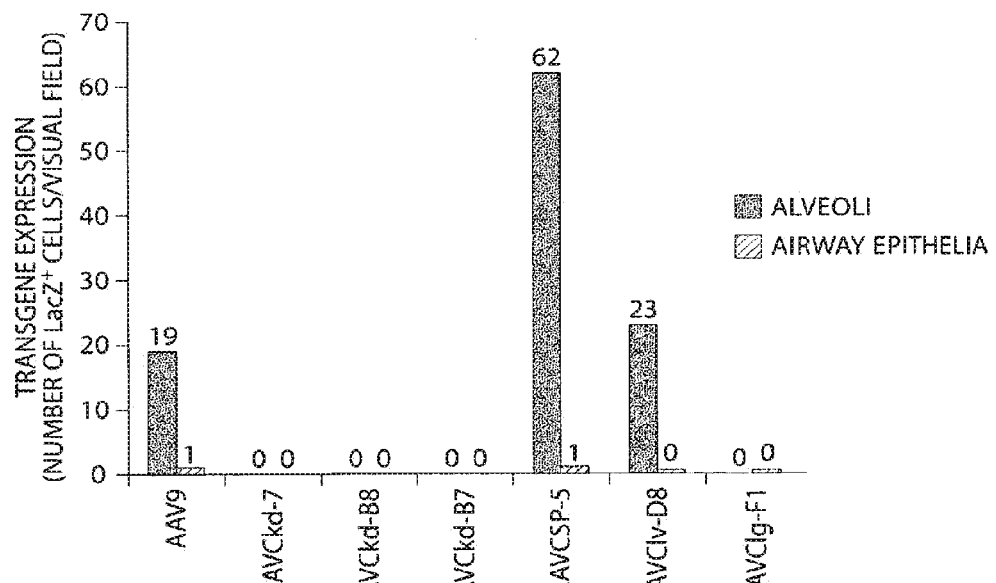

FIG. 15 depicts transduction efficiency of AAV variants in Lung.

DETAILED DESCRIPTION

Adeno-associated virus (AAV) is a small (~26 nm) replication-defective, nonenveloped virus, that depends on the presence of a second virus, such as adenovirus or herpes virus, for its growth in cells. AAV is not known to cause disease and induces a very mild immune response. AAV can infect both dividing and non-dividing cells and may incorporate its genome into that of the host cell. These features make AAV a very attractive candidate for creating viral vectors for gene therapy. Prototypical AAV vectors based on serotype 2 provided a proof-of-concept for non-toxic and stable gene transfer in murine and large animal models, but exhibited poor gene transfer efficiency in many major target tissues. The invention in some aspects seeks to overcome this shortcoming by providing novel AAVs having distinct tissue targeting capabilities for gene therapy and research applications.

In some aspects of the invention new AAV capsid proteins are provided that have distinct tissue targeting capabilities. In some embodiments, an AAV capsid protein is isolated from the tissue to which an AAV comprising the capsid protein targets. In some aspects, methods for delivering a transgene to a target tissue in a subject are provided. The transgene delivery methods may be used for gene therapy (e.g., to treat disease) or research (e.g., to create a somatic transgenic animal model) applications.

Methods for Discovering AAVs

Much of the biology of AAV is dictated by its capsid. Consequently, methods for discovering novel AAVs have been largely focused on isolating DNA sequences for AAV capsids. A central feature of the adeno-associated virus (AAV) latent life cycle is persistence in the form of integrated and/or episomal genomes in a host cell. To date, the primary methods used for isolating novel AAV include PCR based molecular rescue of latent AAV DNA genomes, infectious virus rescue of latent proviral genome from tissue DNAs in vitro in the presence of adenovirus helper function, and rescue of circular proviral genome from tissue DNAs by rolling-circle-linear amplification, mediated by an isothermal phage Phi-29 polymerase. All of these isolation methods take advantage of the latency of AAV proviral DNA genomes and focus on rescuing persistent viral genomic DNA. A major challenge in DNA-targeted AAV isolation is that the abundance of persisted AAV genomes is often very low in most tissues particularly in human tissues, which makes AAV rescue unachievable in many cases. In some cases, PCR-based DNA recovery methods capture all endogenous AAVs, tinting the libraries of AAV proviral sequences with singleton bearing nonfunctional species.

Endogenous latent AAV genomes are transcriptionally active in mammalian cells (e.g., cells of nonhuman primate tissues such as liver, spleen and lymph nodes). Without wishing to bound by theory, it is hypothesized that to maintain AAV persistence in host, low levels of transcription from AAV genes could be required and the resulting cap RNA could serve as more suitable and abundant substrates to retrieve functional cap sequences for vector development. Both rep and cap gene transcripts are detected with variable abundances by RNA detection methods (e.g., RT-PCR). The presence of cap gene transcripts and ability to generate cDNA of cap RNA through reverse transcription (RT) in vitro significantly increases abundance of templates for PCR-based rescue of novel cap sequences from tissues and enhance the sensitivity of novel AAV discovery.

Novel cap sequences may also be identified by transfecting cells with total cellular DNAs isolated from the tissues that harbor proviral AAV genomes at very low abundance, The cells may be further transfected with genes that provide helper virus function (e.g., adenovirus) to trigger and/or boost AAV gene transcription in the transfected cells. Novel cap sequences of the invention may be identified by isolating cap mRNA from the transfected cells, creating cDNA from the mRNA (e.g., by RT-PCR) and sequencing the cDNA.

Isolated Capsid Proteins and Nucleic Acids Encoding the Sames

AAVs are natural inhabitants in mammals. AAVs isolated from mammals, particularly non-human primates, are useful for creating gene transfer vectors for clinical development and human gene therapy applications. The invention provides in some aspects novel AAVs that have been discovered in various non-human primate tissues using the methods disclosed herein. Nucleic acids encoding capsid proteins of these novel AAVs have been discovered in both viral genomic DNA and mRNA isolated from the non-human primate tissues. Nucleic acid and protein sequences as well as other information regarding the AAVs are set forth in Tables 3A-C and in the sequence listing.

Isolated nucleic acids of the invention that encode AAV capsid proteins include any nucleic acid having a sequence as set forth in any one of SEQ ID NOs 13-86 as well as any nucleic acid having a sequence with substantial homology thereto. In some embodiments, the invention provides an isolated nucleic acid that has substantial homology with a nucleic acid having a sequence as set forth in any one of SEQ ID NOs 13-86, but that does not encode a protein having an amino acid sequence as set forth in any one of SEQ ID NOs 177-183.

Furthermore, isolated AAV capsid proteins of the invention include any protein having an amino acid sequence as set forth in any one of SEQ ID NOs 87-160 and 171-176, as well as any protein having substantial homology thereto. In some embodiments, the invention provides an isolated capsid protein that has substantial homology with a protein having a sequence as set forth in any one of SEQ ID NOs 87-160 and 171-176, but that does not have an amino acid sequence as set forth in any one of SEQ ID NOs 177-183.

"Homology" refers to the percent identity between two polynucleotide or two polypeptide moieties. The term "substantial homology", when referring to a nucleic acid, or fragment thereof, indicates that, when optimally aligned with appropriate nucleotide insertions or deletions with another nucleic acid (or its complementary strand), there is nucleotide sequence identity in about 90 to 100% of the aligned sequences. When referring to a polypeptide, or fragment thereof, the term "substantial homology" indicates that, when optimally aligned with appropriate gaps, insertions or deletions with another polypeptide, there is nucleotide sequence identity in about 90 to 100% of the aligned sequences. The term "highly conserved" means at least 80% identity, preferably at least 90% identity, and more preferably, over 97% identity. In some cases, highly conserved may refer to 100% identity. Identity is readily determined by one of skill in the art by, for example, the use of algorithms and computer programs known by those of skill in the art.

As described herein, alignments between sequences of nucleic acids or polypeptides are performed using any of a variety of publicly or commercially available Multiple Sequence Alignment Programs, such as "Clustal W", accessible through Web Servers on the internet. Alternatively, Vector NTI utilities may also be used. There are also a number of algorithms known in the art which can be used to measure nucleotide sequence identity, including those contained in the programs described above. As another example, polynucleotide sequences can be compared using BLASTN, which provides alignments and percent sequence identity of the regions of the best overlap between the query and search sequences. Similar programs are available for the comparison of amino acid sequences, e.g., the "Clustal X" program, BLASTP. Typically, any of these programs are used at default settings, although one of skill in the art can alter these settings as needed. Alternatively, one of skill in the art can utilize another algorithm or computer program which provides at least the level of identity or alignment as that provided by the referenced algorithms and programs. Alignments may be used to identify corresponding amino acids between two proteins or peptides. A "corresponding amino acid" is an amino acid of a protein or peptide sequence that has been aligned with an amino acid of another protein or peptide sequence. Corresponding amino acids may be identical or non-identical. A corresponding amino acid that is a non-identical amino acid may be referred to as a variant amino acid. Tables of corresponding amino acids among various AAV variants is provided in Table 4A-C, for example.

Alternatively for nucleic acids, homology can be determined by hybridization of polynucleotides under conditions which form stable duplexes between homologous regions, followed by digestion with single-stranded-specific nuclease(s), and size determination of the digested fragments. DNA sequences that are substantially homologous can be identified in a Southern hybridization experiment under, for example, stringent conditions, as defined for that particular system. Defining appropriate hybridization conditions is within the skill of the art.

A "nucleic acid" sequence refers to a DNA or RNA sequence. In some embodiments, the term nucleic acid captures sequences that include any of the known base analogues of DNA and RNA such as, but not limited to 4-acetylcytosine, 8-hydroxy-N6-methyladenosine, aziridinylcytosine, pseudoisocytosine, 5-(carboxyhydroxyl-methyl) uracil, 5-fluorouracil, 5-bromouracil, 5-carboxymethylaminomethyl-2-thiouracil, 5-carboxymethyl-aminomethyluracil, dihydrouracil, inosine, N6-isopentenyladenine, 1-methyladenine, 1-methylpseudo-uracil, 1-methylguanine, 1-methylinosine, 2,2-dimethyl-guanine, 2-methyladenine, 2-methylguanine, 3-methyl-cytosine, 5-methylcytosine, N6-methyladenine, 7-methylguanine, 5-methylaminomethyluracil, 5-methoxyamino-methyl-2-thiouracil, beta-D-mannosylqueosine, 5'-methoxycarbonylmethyluracil, 5-methoxyuracil, 2-methylthio-N6-isopentenyladenine, uracil-5-oxyacetic acid methylester, uracil-5-oxyacetic acid, oxybutoxosine, pseudouracil, queosine, 2-thiocytosine, 5-methyl-2-thiouracil, 2-thiouracil, 4-thiouracil, 5-methyluracil, -uracil-5-oxyacetic acid methylester, uracil-5-oxyacetic acid, pseudouracil, queosine, 2-thiocytosine, and 2,6-diaminopurine.

Proteins and nucleic acids of the invention are isolated. As used herein, the term "isolated" means removed from a natural environment or artificially produced. As used herein with respect to nucleic acids, the term "isolated" means: (i) amplified in vitro by, for example, polymerase chain reaction (PCR); (ii) recombinantly produced by cloning; (iii) purified, as by cleavage and gel separation; or (iv) synthesized by, for example, chemical synthesis. An isolated nucleic acid is one which is readily manipulable by recombinant DNA techniques well known in the art. Thus, a nucleotide sequence contained in a vector in which 5' and 3' restriction sites are known or for which polymerase chain reaction (PCR) primer sequences have been disclosed is considered isolated but a nucleic acid sequence existing in its native state in its natural host is not. An isolated nucleic acid may be substantially purified, but need not be. For example, a nucleic acid that is isolated within a cloning or expression vector is not pure in that it may comprise only a tiny percentage of the material in the cell in which it resides. Such a nucleic acid is isolated, however, as the term is used herein because it is readily manipulable by standard techniques known to those of ordinary skill in the art. As used herein with respect to proteins or peptides, the term "isolated" refers to a protein or peptide that has been isolated from its natural environment or artificially produced (e.g., by chemical synthesis, by recombinant DNA technology, etc.).

The skilled artisan will also realize that conservative amino acid substitutions may be made to provide functionally equivalent variants, or homologs of the capsid proteins. In some aspects the invention embraces sequence alterations that result in conservative amino acid substitutions. As used herein, a conservative amino acid substitution refers to an amino acid substitution that does not alter the relative charge or size characteristics of the protein in which the amino acid substitution is made. Variants can be prepared according to methods for altering polypeptide sequence known to one of ordinary skill in the art such as are found in references that compile such methods, e.g. Molecular Cloning: A Laboratory Manual, J. Sambrook, et al., eds., Second Edition, Cold Spring Harbor Laboratory Press, Cold Spring Harbor, N.Y., 1989, or Current Protocols in Molecular Biology, F. M. Ausubel, et al., eds., John Wiley & Sons, Inc., New York. Conservative substitutions of amino acids include substitutions made among amino acids within the following groups: (a) M, I, L, V; (b) F, Y, W; (c) K, R, H; (d) A, G; (e) S, T; (f) Q, N; and (g) E, D. Therefore, one can make conservative amino acid substitutions to the amino acid sequence of the proteins and polypeptides disclosed herein.

An example of an isolated nucleic acid that encodes an AAV capsid protein is a nucleic acid having a sequence selected from the group consisting of: SEQ ID NO: 13-86. A fragment of an isolated nucleic acid encoding a AAV capsid sequence may be useful for constructing a nucleic acid encoding a desired capsid sequence. Fragments may be of any appropriate length. The fragment may be a fragment that does not encode a peptide that is identical to a sequence of any one of SEQ ID NOs: 179-185. For example, a fragment of nucleic acid sequence encoding a variant amino acid (compared with a known AAV serotype) may be used to construct, or may be incorporated within, a nucleic acid sequence encoding an AAV capsid sequence to alter the properties of the AAV capsid. For example, a nucleic sequence encoding an AAV variant (e.g., Csp3) may comprise n amino acid variants compared with a known AAV serotype (e.g., AAV9). A recombinant cap sequence may be constructed having one or more of the n amino acid variants by incorporating fragments of a nucleic acid sequence comprising a region encoding a variant amino acid into the sequence of a nucleic acid encoding the known AAV serotype. The fragments may be incorporated by any appropriate method, including using site directed mutagenesis. Thus, new AAV variants may be created having new properties.

Recombinant AAVs

In some aspects, the invention provides isolated AAVs. As used herein with respect to AAVs, the term "isolated" refers to an AAV that has been isolated from its natural environment (e.g., from a host cell, tissue, or subject) or artificially produced. Isolated AAVs may be produced using recombinant methods. Such AAVs are referred to herein as "recombinant AAVs". Recombinant AAVs (rAAVs) preferably have tissue-specific targeting capabilities, such that a transgene of the rAAV will be delivered specifically to one or more predetermined tissue(s). The AAV capsid is an important element in determining these tissue-specific targeting capabilities. Thus, an rAAV having a capsid appropriate for the tissue being targeted can be selected. In some embodiments, the rAAV comprises a capsid protein having an amino acid sequence as set forth in any one of SEQ ID NOs 87-160 and 171-178, or a protein having substantial homology thereto.

Methods for obtaining recombinant AAVs having a desired capsid protein are well known in the art. (See, for example, US 2003/0138772), the contents of which are incorporated herein by reference in their entirety). Typically the methods involve culturing a host cell which contains a nucleic acid sequence encoding an AAV capsid protein (e.g., a nucleic acid having a sequence as set forth in any one of SEQ ID NOs 13-86) or fragment thereof; a functional rep gene; a recombinant AAV vector composed of, AAV inverted terminal repeats (ITRs) and a transgene; and sufficient helper functions to permit packaging of the recombinant AAV vector into the AAV capsid proteins.

The components to be cultured in the host cell to package a rAAV vector in an AAV capsid may be provided to the host cell in trans. Alternatively, any one or more of the required components (e.g., recombinant AAV vector, rep sequences, cap sequences, and/or helper functions) may be provided by a stable host cell which has been engineered to contain one or more of the required components using methods known to those of skill in the art. Most suitably, such a stable host cell will contain the required component(s) under the control of an inducible promoter. However, the required component(s) may be under the control of a constitutive promoter. Examples of suitable inducible and constitutive promoters are provided herein, in the discussion of regulatory elements suitable for use with the transgene. In still another alternative, a selected stable host cell may contain selected component(s) under the control of a constitutive promoter and other selected component(s) under the control of one or more inducible promoters. For example, a stable host cell may be generated which is derived from 293 cells (which contain E1 helper functions under the control of a constitutive promoter), but which contain the rep and/or cap proteins under the control of inducible promoters. Still other stable host cells may be generated by one of skill in the art.

The recombinant AAV vector, rep sequences, cap sequences, and helper functions required for producing the rAAV of the invention may be delivered to the packaging host cell using any appropriate genetic element (vector). The selected genetic element may be delivered by any suitable method, including those described herein. The methods used to construct any embodiment of this invention are known to those with skill in nucleic acid manipulation and include genetic engineering, recombinant engineering, and synthetic techniques. See, e.g., Sambrook et al, Molecular Cloning: A Laboratory Manual, Cold Spring Harbor Press, Cold Spring Harbor, N.Y. Similarly, methods of generating rAAV virions are well known and the selection of a suitable method is not a limitation on the present invention. See, e.g., K. Fisher et al, J. Virol., 70:520-532 (1993) and U.S. Pat. No. 5,478,745.

In some embodiments, recombinant AAVs may be produced using the triple transfection method (described in detail in U.S. Pat. No. 6,001,650). Typically, the recombinant AAVs are produced by transfecting a host cell with an recombinant AAV vector (comprising a transgene) to be packaged into AAV particles, an AAV helper function vector, and an accessory function vector. An AAV helper function vector encodes the "AAV helper function" sequences (i.e., rep and cap), which function in trans for productive AAV replication and encapsidation. Preferably, the AAV helper function vector supports efficient AAV vector production without generating any detectable wild-type AAV virions (i.e., AAV virions containing functional rep and cap genes). Non-limiting examples of vectors suitable for use with the present invention include pHLP19, described in U.S. Pat. No. 6,001,650 and pRep6cap6 vector, described in U.S. Pat. No. 6,156,303, the entirety of both incorporated by reference herein. The accessory function vector encodes nucleotide sequences for non-AAV derived viral and/or cellular functions upon which AAV is dependent for replication (i.e., "accessory functions"). The accessory functions include those functions required for AAV replication, including, without limitation, those moieties involved in activation of AAV gene transcription, stage specific AAV mRNA splicing, AAV DNA replication, synthesis of cap expression products, and AAV capsid assembly. Viral-based accessory functions can be derived from any of the known helper viruses such as adenovirus, herpesvirus (other than herpes simplex virus type-1), and vaccinia virus.

In some aspects, the invention provides transfected host cells. The term "transfection" is used to refer to the uptake of foreign DNA by a cell, and a cell has been "transfected" when exogenous DNA has been introduced inside the cell membrane. A number of transfection techniques are generally known in the art. See, e.g., Graham et al. (1973) Virology, 52:456, Sambrook et al. (1989) Molecular Cloning, a laboratory manual, Cold Spring Harbor Laboratories, New York, Davis et al. (1986) Basic Methods in Molecular Biology, Elsevier, and Chu et al. (1981) Gene 13:197. Such techniques can be used to introduce one or more exogenous nucleic acids, such as a nucleotide integration vector and other nucleic acid molecules, into suitable host cells.

A "host cell" refers to any cell that harbors, or is capable of harboring, a substance of interest. Often a host cell is a mammalian cell. A host cell may be used as a recipient of an AAV helper construct, an AAV minigene plasmid, an accessory function vector, or other transfer DNA associated with the production of recombinant AAVs. The term includes the progeny of the original cell which has been transfected. Thus, a "host cell" as used herein may refer to a cell which has been transfected with an exogenous DNA sequence. It is understood that the progeny of a single parental cell may not necessarily be completely identical in morphology or in genomic or total DNA complement as the original parent, due to natural, accidental, or deliberate mutation.

As used herein, the term "cell line" refers to a population of cells capable of continuous or prolonged growth and division in vitro. Often, cell lines are clonal populations derived from a single progenitor cell. It is further known in the art that spontaneous or induced changes can occur in karyotype during storage or transfer of such clonal populations. Therefore, cells derived from the cell line referred to may not be precisely identical to the ancestral cells or cultures, and the cell line referred to includes such variants.

As used herein, the terms "recombinant cell" refers to a cell into which an exogenous DNA segment, such as DNA segment that leads to the transcription of a biologically-active polypeptide or production of a biologically active nucleic acid such as an RNA, has been introduced.

As used herein, the term "vector" includes any genetic element, such as a plasmid, phage, transposon, cosmid, chromosome, artificial chromosome, virus, virion, etc., which is capable of replication when associated with the proper control elements and which can transfer gene sequences between cells. Thus, the term includes cloning and expression vehicles, as well as viral vectors. In some embodiments, useful vectors are contemplated to be those vectors in which the nucleic acid segment to be transcribed is positioned under the transcriptional control of a promoter. A "promoter" refers to a DNA sequence recognized by the synthetic machinery of the cell, or introduced synthetic machinery, required to initiate the specific transcription of a gene. The phrases "operatively positioned," "under control" or "under transcriptional control" means that the promoter is in the correct location and orientation in relation to the nucleic acid to control RNA polymerase initiation and expression of the gene. The term "expression vector or construct" means any type of genetic construct containing a nucleic acid in which part or all of the nucleic acid encoding sequence is capable of being transcribed. In some embodiments, expression includes transcription of the nucleic acid, for example, to generate a biologically-active polypeptide product or inhibitory RNA (e.g., shRNA, miRNA, miRNA inhibitor) from a transcribed gene.

The foregoing methods for packaging recombinant vectors in desired AAV capsids to produce the rAAVs of the invention are not meant to be limiting and other suitable methods will be apparent to the skilled artisan.

Recombinant AAV Vectors

"Recombinant AAV (rAAV) vectors" of the invention are typically composed of, at a minimum, a transgene and its regulatory sequences, and 5' and 3' AAV inverted terminal repeats (ITRs). It is this recombinant AAV vector which is packaged into a capsid protein and delivered to a selected target cell. In some embodiments, the transgene is a nucleic acid sequence, heterologous to the vector sequences, which encodes a polypeptide, protein, functional RNA molecule (e.g., miRNA, miRNA inhibitor) or other gene product, of interest. The nucleic acid coding sequence is operatively linked to regulatory components in a manner which permits transgene transcription, translation, and/or expression in a cell of a target tissue.

The AAV sequences of the vector typically comprise the cis-acting 5' and 3' inverted terminal repeat sequences (See, e.g., B. J. Carter, in "Handbook of Parvoviruses", ed., P. Tijsser, CRC Press, pp. 155 168 (1990)). The ITR sequences are about 145 bp in length. Preferably, substantially the entire sequences encoding the ITRs are used in the molecule, although some degree of minor modification of these sequences is permissible. The ability to modify these ITR sequences is within the skill of the art. (See, e.g., texts such as Sambrook et al, "Molecular Cloning. A Laboratory Manual", 2d ed., Cold Spring Harbor Laboratory, New York (1989); and K. Fisher et al., J. Virol., 70:520 532 (1996)). An example of such a molecule employed in the present invention is a "cis-acting" plasmid containing the transgene, in which the selected transgene sequence and associated regulatory elements are flanked by the 5' and 3' AAV ITR sequences. The AAV ITR sequences may be obtained from any known AAV, including presently identified mammalian AAV types.

In addition to the major elements identified above for the recombinant AAV vector, the vector also includes conventional control elements necessary which are operably linked to the transgene in a manner which permits its transcription, translation and/or expression in a cell transfected with the plasmid vector or infected with the virus produced by the invention. As used herein, "operably linked" sequences include both expression control sequences that are contiguous with the gene of interest and expression control sequences that act in trans or at a distance to control the gene of interest.

Expression control sequences include appropriate transcription initiation, termination, promoter and enhancer sequences; efficient RNA processing signals such as splicing and polyadenylation (polyA) signals; sequences that stabilize cytoplasmic mRNA; sequences that enhance translation efficiency (i.e., Kozak consensus sequence); sequences that enhance protein stability; and when desired, sequences that enhance secretion of the encoded product. A great number of expression control sequences, including promoters which are native, constitutive, inducible and/or tissue-specific, are known in the art and may be utilized.

As used herein, a nucleic acid sequence (e.g., coding sequence) and regulatory sequences are said to be "operably" linked when they are covalently linked in such a way as to place the expression or transcription of the nucleic acid sequence under the influence or control of the regulatory sequences. If it is desired that the nucleic acid sequences be translated into a functional protein, two DNA sequences are said to be operably linked if induction of a promoter in the 5' regulatory sequences results in the transcription of the coding sequence and if the nature of the linkage between the two DNA sequences does not (1) result in the introduction of a frame-shift mutation, (2) interfere with the ability of the promoter region to direct the transcription of the coding sequences, or (3) interfere with the ability of the corresponding RNA transcript to be translated into a protein. Thus, a promoter region would be operably linked to a nucleic acid sequence if the promoter region were capable of effecting transcription of that DNA sequence such that the resulting transcript might be translated into the desired protein or polypeptide. Similarly two or more coding regions are operably linked when they are linked in such a way that their transcription from a common promoter results in the expression of two or more proteins having been translated in frame. In some embodiments, operably linked coding sequences yield a fusion protein. In some embodiments, operably linked coding sequences yield a functional RNA (e.g., shRNA, miRNA, miRNA inhibitor).

For nucleic acids encoding proteins, a polyadenylation sequence generally is inserted following the transgene sequences and before the 3' AAV ITR sequence. A rAAV construct useful in the present invention may also contain an intron, desirably located between the promoter/enhancer sequence and the transgene. One possible intron sequence is derived from SV-40, and is referred to as the SV-40 T intron sequence. Another vector element that may be used is an internal ribosome entry site (IRES). An IRES sequence is used to produce more than one polypeptide from a single gene transcript. An IRES sequence would be used to produce a protein that contain more than one polypeptide chains. Selection of these and other common vector elements are conventional and many such sequences are available [see, e.g., Sambrook et al, and references cited therein at, for example, pages 3.18 3.26 and 16.17 16.27 and Ausubel et al., Current Protocols in Molecular Biology, John Wiley & Sons, New York, 1989]. In some embodiments, a Foot and Mouth Disease Virus 2A sequence is included in polyprotein; this is a small peptide (approximately 18 amino acids in length) that has been shown to mediate the cleavage of polyproteins (Ryan, M D et al., EMBO, 1994; 4: 928-933; Mattion, N M et al., J Virology, November 1996; p. 8124-8127; Furler, S et al., Gene Therapy, 2001; 8: 864-873; and Halpin, C et al., The Plant Journal, 1999; 4: 453-459). The cleavage activity of the 2A sequence has previously been demonstrated in artificial systems including plasmids and gene therapy vectors (AAV and retroviruses) (Ryan, M D et al., EMBO, 1994; 4: 928-933; Mattion, N M et al., J Virology, November 1996; p. 8124-8127; Furler, S et al., Gene Therapy, 2001; 8: 864-873; and Halpin, C et al., The Plant Journal, 1999; 4: 453-459; de Felipe, P et al., Gene Therapy, 1999; 6: 198-208; de Felipe, P et al., Human Gene Therapy, 2000; 11: 1921-1931.; and Klump, H et al., Gene Therapy, 2001; 8: 811-817).

The precise nature of the regulatory sequences needed for gene expression in host cells may vary between species, tissues or cell types, but shall in general include, as necessary, 5' non-transcribed and 5' non-translated sequences involved with the initiation of transcription and translation respectively, such as a TATA box, capping sequence, CAAT sequence, enhancer elements, and the like. Especially, such 5' non-transcribed regulatory sequences will include a promoter region that includes a promoter sequence for transcriptional control of the operably joined gene. Regulatory sequences may also include enhancer sequences or upstream activator sequences as desired. The vectors of the invention may optionally include 5' leader or signal sequences. The choice and design of an appropriate vector is within the ability and discretion of one of ordinary skill in the art.

Examples of constitutive promoters include, without limitation, the retroviral Rous sarcoma virus (RSV) LTR promoter (optionally with the RSV enhancer), the cytomegalovirus (CMV) promoter (optionally with the CMV enhancer) [see, e.g., Boshart et al, Cell, 41:521-530 (1985)], the SV40 promoter, the dihydrofolate reductase promoter, the β-actin promoter, the phosphoglycerol kinase (PGK) promoter, and the EF1α promoter [Invitrogen].

Inducible promoters allow regulation of gene expression and can be regulated by exogenously supplied compounds, environmental factors such as temperature, or the presence of a specific physiological state, e.g., acute phase, a particular differentiation state of the cell, or in replicating cells only. Inducible promoters and inducible systems are available from a variety of commercial sources, including, without limitation, Invitrogen, Clontech and Ariad. Many other systems have been described and can be readily selected by one of skill in the art. Examples of inducible promoters regulated by exogenously supplied promoters include the zinc-inducible sheep metallothionine (MT) promoter, the dexamethasone (Dex)-inducible mouse mammary tumor virus (MMTV) promoter, the T7 polymerase promoter system (WO 98/10088); the ecdysone insect promoter (No et al, Proc. Natl. Acad. Sci. USA, 93:3346-3351 (1996)), the tetracycline-repressible system (Gossen et al, Proc. Natl. Acad. Sci. USA, 89:5547-5551 (1992)), the tetracycline-inducible system (Gossen et al, Science, 268:1766-1769 (1995), see also Harvey et al, Curr. Opin. Chem. Biol., 2:512-518 (1998)), the RU486-inducible system (Wang et al, Nat. Biotech., 15:239-243 (1997) and Wang et al, Gene Ther., 4:432-441 (1997)) and the rapamycin-inducible system (Magari et al, J. Clin. Invest., 100:2865-2872 (1997)). Still other types of inducible promoters which may be useful in this context are those which are regulated by a specific physiological state, e.g., temperature, acute phase, a particular differentiation state of the cell, or in replicating cells only.

In another embodiment, the native promoter for the transgene will be used. The native promoter may be preferred when it is desired that expression of the transgene should mimic the native expression. The native promoter may be used when expression of the transgene must be regulated temporally or developmentally, or in a tissue-specific manner, or in response to specific transcriptional stimuli. In a further embodiment, other native expression control elements, such as enhancer elements, polyadenylation sites or Kozak consensus sequences may also be used to mimic the native expression.

In some embodiments, the regulatory sequences impart tissue-specific gene expression capabilities. In some cases, the tissue-specific regulatory sequences bind tissue-specific transcription factors that induce transcription in a tissue specific manner. Such tissue-specific regulatory sequences (e.g., promoters, enhancers, etc.) are well known in the art. Exemplary tissue-specific regulatory sequences include, but are not limited to the following tissue specific promoters: a liver-specific thyroxin binding globulin (TBG) promoter, a insulin promoter, a glucagon promoter, a somatostatin promoter, a pancreatic polypeptide (PPY) promoter, a synapsin-1 (Syn) promoter, a creatine kinase (MCK) promoter, a mammalian desmin (DES) promoter, a α-myosin heavy chain (a-MHC) promoter, or a cardiac Troponin T (cTnT) promoter. Other exemplary promoters include Beta-actin promoter, hepatitis B virus core promoter, Sandig et al., Gene Ther., 3:1002-9 (1996); alpha-fetoprotein (AFP) promoter, Arbuthnot et al., Hum. Gene Ther., 7:1503-14 (1996)), bone osteocalcin promoter (Stein et al., Mol. Biol. Rep., 24:185-96 (1997)); bone sialoprotein promoter (Chen et al., J. Bone Miner. Res., 11:654-64 (1996)), CD2 promoter (, Hansal et al., J. Immunol., 161:1063-8 (1998); immunoglobulin heavy chain promoter; T cell receptor α-chain promoter, neuronal such as neuron-specific enolase (NSE) promoter (Andersen et al., Cell. Mol. Neurobiol., 13:503-15 (1993)), neurofilament light-chain gene promoter (Piccioli et al., Proc. Natl. Acad. Sci. USA, 88:5611-5 (1991)), and the neuron-specific vgf gene promoter (Piccioli et al., Neuron, 15:373-84 (1995)), among others which will be apparent to the skilled artisan.

In some embodiments, one or more bindings sites for one or more of miRNAs are incorporated in a transgene of a rAAV vector, to inhibit the expression of the transgene in one or more tissues of an subject harboring the transgene. The skilled artisan will appreciate that binding sites may be selected to control the expression of a trangene in a tissue specific manner. For example, binding sites for the liver-specific miR-122 may be incorporated into a transgene to inhibit expression of that transgene in the liver. The target sites in the mRNA may be in the 5' UTR, the 3' UTR or in the coding region. Typically, the target site is in the 3' UTR of the mRNA. Furthermore, the transgene may be designed such that multiple miRNAs regulate the mRNA by recognizing the same or multiple sites. The presence of multiple miRNA binding sites may result in the cooperative action of multiple RISCs and provide highly efficient inhibition of expression. The target site sequence may comprise a total of 5-100, 10-60, or more nucleotides. The target site sequence may comprise at least 5 nucleotides of the sequence of a target gene binding site.

Recombinant AAV Vector: Transgene Coding Sequences

The composition of the transgene sequence of the rAAV vector will depend upon the use to which the resulting vector will be put. For example, one type of transgene sequence includes a reporter sequence, which upon expression produces a detectable signal. In another example, the trangene encodes a therapeutic protein or therapeutic functional RNA. In another example, the transgene encodes a protein or functional RNA that is intended to be used for research purposes, e.g., to create a somatic transgenic animal model harboring the transgene, e.g., to study the function of the transgene product. In another example, the transgene encodes a protein or functional RNA that is intended to be used to create an animal model of disease. Appropriate transgene coding sequences will be apparent to the skilled artisan.

Reporter sequences that may be provided in a transgene include, without limitation, DNA sequences encoding β-lactamase, β-galactosidase (LacZ), alkaline phosphatase, thymidine kinase, green fluorescent protein (GFP), chloramphenicol acetyltransferase (CAT), luciferase, and others well known in the art. When associated with regulatory elements which drive their expression, the reporter sequences, provide signals detectable by conventional means, including enzymatic, radiographic, colorimetric, fluorescence or other spectrographic assays, fluorescent activating cell sorting assays and immunological assays, including enzyme linked immunosorbent assay (ELISA), radioimmunoassay (RIA) and immunohistochemistry. For example, where the marker sequence is the LacZ gene, the presence of the vector carrying the signal is detected by assays for 3-galactosidase activity. Where the transgene is green fluorescent protein or luciferase, the vector carrying the signal may be measured visually by color or light production in a luminometer. Such reporters can, for example, be useful in verifying the tissue-specific targeting capabilities and tissue specific promoter regulatory activity of an rAAV.

In some aspects, the invention provides rAAV vectors for use in methods of preventing or treating one or more genetic deficiencies or dysfunctions in a mammal, such as for example, a polypeptide deficiency or polypeptide excess in a mammal, and particularly for treating or reducing the severity or extent of deficiency in a human manifesting one or more of the disorders linked to a deficiency in such polypeptides in cells and tissues. The method involves administration of an rAAV vector that encodes one or more therapeutic peptides, polypeptides, siRNAs, microRNAs, antisense nucleotides, etc. in a pharmaceutically-acceptable carrier to the subject in an amount and for a period of time sufficient to treat the deficiency or disorder in the subject suffering from such a disorder.

Thus, the invention embraces the delivery of rAAV vectors encoding one or more peptides, polypeptides, or proteins, which are useful for the treatment or prevention of disease states in a mammalian subject. Exemplary therapeutic proteins include one or more polypeptides selected from the group consisting of growth factors, interleukins, interferons, anti-apoptosis factors, cytokines, anti-diabetic factors, anti-apoptosis agents, coagulation factors, anti-tumor factors. Other non-limiting examples of therapeutic proteins include BDNF, CNTF, CSF, EGF, FGF, G-SCF, GM-CSF, gonadotropin, IFN, IFG-1, M-CSF, NGF, PDGF, PEDF, TGF, VEGF, TGF-B2, TNF, prolactin, somatotropin, XIAP1, IL-1, IL-2, IL-3, IL-4, IL-5, IL-6, IL-7, IL-8, IL-9, IL-10, IL-10(187A), viral IL-10, IL-11, IL-12, IL-13, IL-14, IL-15, IL-16 IL-17, and IL-18.

The rAAV vectors may comprise a gene to be transferred to a subject to treat a disease associated with reduced expression, lack of expression or dysfunction of the gene. Exemplary genes and associated disease states include, but are not limited to: glucose-6-phosphatase, associated with glycogen storage deficiency type 1A; phosphoenolpyruvate-carboxykinase, associated with Pepck deficiency; galactose-1 phosphate uridyl transferase, associated with galactosemia; phenylalanine hydroxylase, associated with phenylketonuria; branched chain alpha-ketoacid dehydrogenase, associated with Maple syrup urine disease; fumarylacetoacetate hydrolase, associated with tyrosinemia type 1; methylmalonyl- CoA mutase, associated with methylmalonic acidemia; medium chain acyl CoA dehydrogenase, associated with medium chain acetyl CoA deficiency; ornithine transcarbamylase, associated with ornithine transcarbamylase deficiency; argininosuccinic acid synthetase, associated with citrullinemia; low density lipoprotein receptor protein, associated with familial hypercholesterolemia; UDP-glucouronosyltransferase, associated with Crigler-Najjar disease; adenosine deaminase, associated with severe combined immunodeficiency disease; hypoxanthine guanine phosphoribosyl transferase, associated with Gout and Lesch-Nyan syndrome; biotimidase, associated with biotimidase deficiency; beta-glucocerebrosidase, associated with Gaucher disease; beta-glucuronidase, associated with Sly syndrome; peroxisome membrane protein 70 kDa, associated with Zellweger syndrome; porphobilinogen deaminase, associated with acute intermittent porphyria; alpha-1 antitrypsin for treatment of alpha-1 antitrypsin deficiency (emphysema); erythropoietin for treatment of anemia due to thalassemia or to renal failure; vascular endothelial growth factor, angiopoietin-1, and fibroblast growth factor for the treatment of ischemic diseases; thrombomodulin and tissue factor pathway inhibitor for the treatment of occluded blood vessels as seen in, for example, atherosclerosis, thrombosis, or embolisms; aromatic amino acid decarboxylase (AADC), and tyrosine hydroxylase (TH) for the treatment of Parkinson's disease; the beta adrenergic receptor, anti-sense to, or a mutant form of, phospholamban, the sarco(endo)plasmic reticulum adenosine triphosphatase-2 (SERCA2), and the cardiac adenylyl cyclase for the treatment of congestive heart failure; a tumor suppressor gene such as p53 for the treatment of various cancers; a cytokine such as one of the various interleukins for the treatment of inflammatory and immune disorders and cancers; dystrophin or minidystrophin and utrophin or miniutrophin for the treatment of muscular dystrophies; and, insulin for the treatment of diabetes.

The rAAVs of the invention can be used to restore the expression of genes that are reduced in expression, silenced, or otherwise dysfunctional in a subject (e.g., a tumor suppressor that has been silenced in a subject having cancer). The rAAVs of the invention can also be used to knockdown the expression of genes that are aberrantly expressed in a subject (e.g., an oncogene that is expressed in a subject having cancer). In some embodiments, an rAAV vector comprising a nucleic acid encoding a gene product associated with cancer (e.g., tumor suppressors) may be used to treat the cancer, by administering a rAAV harboring the rAAV vector to a subject having the cancer. In some embodiments, an rAAV vector comprising a nucleic acid encoding a small interfering nucleic acid (e.g., shRNAs, miRNAs) that inhibits the expression of a gene product associated with cancer (e.g., oncogenes) may be used to treat the cancer, by administering a rAAV harboring the rAAV vector to a subject having the cancer. In some embodiments, an rAAV vector comprising a nucleic acid encoding a gene product associated with cancer (or a functional RNA that inhibits the expression of a gene associated with cancer) may be used for research purposes, e.g., to study the cancer or to identify therapeutics that treat the cancer. The following is a non-limiting list of exemplary genes known to be associated with the development of cancer (e.g., oncogenes and tumor suppressors): AARS, ABCB1, ABCC4, ABI2, ABL1, ABL2, ACK1, ACP2, ACY1, ADSL, AK1, AKR1C2, AKT1, ALB, ANPEP, ANXA5, ANXA7, AP2M1, APC, ARHGAP5, ARHGEF5, ARID4A, ASNS, ATF4, ATM, ATP5B, ATP5O, AXL, BARD1, BAX, BCL2, BHLHB2, BLMH, BRAF, BRCA1, BRCA2, BTK, CANX, CAP1, CAPN1, CAPNS1, CAV1, CBFB, CBLB, CCL2, CCND1, CCND2, CCND3, CCNE1, CCT5, CCYR61, CD24, CD44, CD59, CDC20, CDC25, CDC25A, CDC25B, CDC2L5, CDK10, CDK4, CDK5, CDK9, CDKL1, CDKN1A, CDKN1B, CDKN1C, CDKN2A, CDKN2B, CDKN2D, CEBPG, CENPC1, CGRRF1, CHAF1A, CIB1, CKMT1, CLK1, CLK2, CLK3, CLNS1A, CLTC, COL1A1, COL6A3, COX6C, COX7A2, CRAT, CRHR1, CSF1R, CSK, CSNK1G2, CTNNA1, CTNNB1, CTPS, CTSC, CTSD, CUL1, CYR61, DCC, DCN, DDX10, DEK, DHCR7, DHRS2, DHX8, DLG3, DVL1, DVL3, E2F1, E2F3, E2F5, EGFR, EGR1, EIF5, EPHA2, ERBB2, ERBB3, ERBB4, ERCC3, ETV1, ETV3, ETV6, F2R, FASTK, FBN1, FBN2, FES, FGFR1, FGR, FKBP8, FN1, FOS, FOSL1, FOSL2, FOXG1A, FOXO1A, FRAP1, FRZB, FTL, FZD2, FZD5, FZD9, G22P1, GAS6, GCN5L2, GDF15, GNA13, GNAS, GNB2, GNB2L1, GPR39, GRB2, GSK3A, GSPT1, GTF2I, HDAC1, HDGF, HMMR, HPRT1, HRB, HSPA4, HSPA5, HSPA8, HSPB1, HSPH1, HYAL1, HYOU1, ICAM1, ID1, ID2, IDUA, IER3, IFITM1, IGF1R, IGF2R, IGFBP3, IGFBP4, IGFBP5, IL1B, ILK, ING1, IRF3, ITGA3, ITGA6, ITGB4, JAK1, JARID1A, JUN, JUNB, JUND, K-ALPHA-1, KIT, KITLG, KLK10, KPNA2, KRAS2, KRT18, KRT2A, KRT9, LAMB1, LAMP2, LCK, LCN2, LEP, LITAF, LRPAP1, LTF, LYN, LZTR1, MADH1, MAP2K2, MAP3K8, MAPK12, MAPK13, MAPKAPK3, MAPRE1, MARS, MAS1, MCC, MCM2, MCM4, MDM2, MDM4, MET, MGST1, MICB, MLLT3, MME, MMP1, MMP14, MMP17, MMP2, MNDA, MSH2, MSH6, MT3, MYB, MYBL1, MYBL2, MYC, MYCL1, MYCN, MYD88, MYL9, MYLK, NEO1, NF1, NF2, NFKB1, NFKB2, NFSF7, NID, NINE, NMBR, NME1, NME2, NME3, NOTCH1, NOTCH2, NOTCH4, NPM1, NQO1, NR1D1, NR2F1, NR2F6, NRAS, NRG1, NSEP1, OSM, PA2G4, PABPC1, PCNA, PCTK1, PCTK2, PCTK3, PDGFA, PDGFB, PDGFRA, PDPK1, PEA15, PFDN4, PFDN5, PGAM1, PHB, PIK3CA, PIK3CB, PIK3CG, PIM1, PKM2, PKMYT1, PLK2, PPARD, PPARG, PPIH, PPP1CA, PPP2R5A, PRDX2, PRDX4, PRKAR1A, PRKCBP1, PRNP, PRSS15, PSMA1, PTCH, PTEN, PTGS1, PTMA, PTN, PTPRN, RAB5A, RAC1, RAD50, RAF1, RALBP1, RAP1A, RARA, RARB, RASGRF1, RB1, RBBP4, RBL2, REA, REL, RELA, RELB, RET, RFC2, RGS19, RHOA, RHOB, RHOC, RHOD, RIPK1, RPN2, RPS6 KB1, RRM1, SARS, SELENBP1, SEMA3C, SEMA4D, SEPP1, SERPINH1, SFN, SFPQ, SFRS7, SHB, SHH, SIAH2, SIVA, SIVA TP53, SKI, SKIL, SLC16A1, SLC1A4, SLC20A1, SMO, SMPD1, SNAI2, SND1, SNRPB2, SOCS1, SOCS3, SOD1, SORT1, SPINT2, SPRY2, SRC, SRPX, STAT1, STAT2, STAT3, STAT5B, STC1, TAF1, TBL3, TBRG4, TCF1, TCF7L2, TFAP2C, TFDP1, TFDP2, TGFA, TGFB1, TGFBI, TGFBR2, TGFBR3, THBS1, TIE, TIMP1, TIMP3, TJP1, TK1, TLE1, TNF, TNFRSF10A, TNFRSF10B, TNFRSF1A, TNFRSF1B, TNFRSF6, TNFSF7, TNK1, TOB1, TP53, TP53BP2, TP5313, TP73, TPBG, TPT1, TRADD, TRAM1, TRRAP, TSG101, TUFM, TXNRD1, TYRO3, UBC, UBE2L6, UCHL1, USP7, VDAC1, VEGF, VHL, VIL2, WEE1, WNT1, WNT2, WNT2B, WNT3, WNT5A, WT1, XRCC1, YES1, YWHAB, YWHAZ, ZAP70, and ZNF9.

A rAAV vector may comprise as a transgene, a nucleic acid encoding a protein or functional RNA that modulates apoptosis. The following is a non-limiting list of genes associated with apoptosis and nucleic acids encoding the products of these genes and their homologues and encoding small interfering nucleic acids (e.g., shRNAs, miRNAs) that inhibit the expression of these genes and their homologues are useful as transgenes in certain embodiments of the invention: RPS27A, ABL1, AKT1, APAF1, BAD, BAG1, BAG3, BAG4, BAK1, BAX, BCL10, BCL2, BCL2A1, BCL2L1, BCL2L10, BCL2L11, BCL2L12, BCL2L13, BCL2L2, BCLAF1, BFAR, BID, BIK, NAIP, BIRC2, BIRC3, XIAP, BIRC5, BIRC6, BIRC7, BIRC8, BNIP1, BNIP2, BNIP3, BNIP3L, BOK, BRAF, CARD10, CARD11, NLRC4, CARD14, NOD2, NOD1, CARD6, CARD8, CARD9, CASP1, CASP10, CASP14, CASP2, CASP3, CASP4, CASP5, CASP6, CASP7, CASP8, CASP9, CFLAR, CIDEA, CIDEB, CRADD, DAPK1, DAPK2, DFFA, DFFB, FADD, GADD45A, GDNF, HRK, IGF1R, LTA, LTBR, MCL1, NOL3, PYCARD, RIPK1, RIPK2, TNF, TNFRSF10A, TNFRSF10B, TNFRSF10C, TNFRSF10D, TNFRSF11B, TNFRSF12A, TNFRSF14, TNFRSF19, TNFRSF1A, TNFRSF1B, TNFRSF21, TNFRSF25, CD40, FAS, TNFRSF6B, CD27, TNFRSF9, TNFSF10, TNFSF14, TNFSF18, CD40LG, FASLG, CD70, TNFSF8, TNFSF9, TP53, TP53BP2, TP73, TP63, TRADD, TRAF1, TRAF2, TRAF3, TRAF4, and TRAF5.

The skilled artisan will also realize that in the case of transgenes encoding proteins or polypeptides, that mutations that results in conservative amino acid substitutions may be made in a transgene to provide functionally equivalent variants, or homologs of a protein or polypeptide. In some aspects the invention embraces sequence alterations that result in conservative amino acid substitution of a transgene. In some embodiments, the transgene comprises a gene having a dominant negative mutation. For example, a transgene may express a mutant protein that interacts with the same elements as a wild-type protein, and thereby blocks some aspect of the function of the wild-type protein.

Useful transgene products also include miRNAs. miRNAs and other small interfering nucleic acids regulate gene expression via target RNA transcript cleavage/degradation or translational repression of the target messenger RNA (mRNA). miRNAs are natively expressed, typically as final 19-25 non-translated RNA products. miRNAs exhibit their activity through sequence-specific interactions with the 3' untranslated regions (UTR) of target mRNAs. These endogenously expressed miRNAs form hairpin precursors which are subsequently processed into a miRNA duplex, and further into a "mature" single stranded miRNA molecule. This mature miRNA guides a multiprotein complex, miRISC, which identifies target site, e.g., in the 3' UTR regions, of target mRNAs based upon their complementarity to the mature miRNA.

The following non-limiting list of miRNA genes, and their homologues, are useful as transgenes or as targets for small interfering nucleic acids encoded by transgenes (e.g., miRNA sponges, antisense oligonucleotides, TuD RNAs) in certain embodiments of the methods: hsa-let-7a, hsa-let-7a*, hsa-let-7b, hsa-let-7b*, hsa-let-7c, hsa-let-7c*, hsa-let-7d, hsa-let-7d*, hsa-let-7e, hsa-let-7e*, hsa-let-7f, hsa-let-7f-1*, hsa-let-7f-2*, hsa-let-7g, hsa-let-7g*, hsa-let-71, hsa-let-71*, hsa-miR-1, hsa-miR-100, hsa-miR-100*, hsa-miR-101, hsa-miR-101*, hsa-miR-103, hsa-miR-105, hsa-miR-105*, hsa-miR-106a, hsa-miR-106a*, hsa-miR-106b, hsa-miR-106b*, hsa-miR-107, hsa-miR-10a, hsa-miR-10a*, hsa-miR-10b, hsa-miR-10b*, hsa-miR-1178, hsa-miR-1179, hsa-miR-1180, hsa-miR-1181, hsa-miR-1182, hsa-miR-1183, hsa-miR-1184, hsa-miR-1185, hsa-miR-1197, hsa-miR-1200, hsa-miR-1201, hsa-miR-1202, hsa-miR-1203, hsa-miR-1204, hsa-miR-1205, hsa-miR-1206, hsa-miR-1207-3p, hsa-miR-1207-5p, hsa-miR-1208, hsa-miR-122, hsa-miR-122*, hsa-miR-1224-3p, hsa-miR-1224-5p, hsa-miR-1225-3p, hsa-miR-1225-5p, hsa-miR-1226, hsa-miR-1226*, hsa-miR-1227, hsa-miR-1228, hsa-miR-1228*, hsa-miR-1229, hsa-miR-1231, hsa-miR-1233, hsa-miR-1234, hsa-miR-1236, hsa-miR-1237, hsa-miR-1238, hsa-miR-124, hsa-miR-124*, hsa-miR-1243, hsa-miR-1244, hsa-miR-1245, hsa-miR-1246, hsa-miR-1247, hsa-miR-1248, hsa-miR-1249, hsa-miR-1250, hsa-miR-1251, hsa-miR-1252, hsa-miR-1253, hsa-miR-1254, hsa-miR-1255a, hsa-miR-1255b, hsa-miR-1256, hsa-miR-1257, hsa-miR-1258, hsa-miR-1259, hsa-miR-125a-3p, hsa-miR-125a-5p, hsa-miR-125b, hsa-miR-125b-1*, hsa-miR-125b-2*, hsa-miR-126, hsa-miR-126*, hsa-miR-1260, hsa-miR-1261, hsa-miR-1262, hsa-miR-1263, hsa-miR-1264, hsa-miR-1265, hsa-miR-1266, hsa-miR-1267, hsa-miR-1268, hsa-miR-1269, hsa-miR-1270, hsa-miR-1271, hsa-miR-1272, hsa-miR-1273, hsa-miR-127-3p, hsa-miR-1274a, hsa-miR-1274b, hsa-miR-1275, hsa-miR-127-5p, hsa-miR-1276, hsa-miR-1277, hsa-miR-1278, hsa-miR-1279, hsa-miR-128, hsa-miR-1280, hsa-miR-1281, hsa-miR-1282, hsa-miR-1283, hsa-miR-1284, hsa-miR-1285, hsa-miR-1286, hsa-miR-1287, hsa-miR-1288, hsa-miR-1289, hsa-miR-129*, hsa-miR-1290, hsa-miR-1291, hsa-miR-1292, hsa-miR-1293, hsa-miR-129-3p, hsa-miR-1294, hsa-miR-1295, hsa-miR-129-5p, hsa-miR-1296, hsa-miR-1297, hsa-miR-1298, hsa-miR-1299, hsa-miR-1300, hsa-miR-1301, hsa-miR-1302, hsa-miR-1303, hsa-miR-1304, hsa-miR-1305, hsa-miR-1306, hsa-miR-1307, hsa-miR-1308, hsa-miR-130a, hsa-miR-130a*, hsa-miR-130b, hsa-miR-130b*, hsa-miR-132, hsa-miR-132*, hsa-miR-1321, hsa-miR-1322, hsa-miR-1323, hsa-miR-1324, hsa-miR-133a, hsa-miR-133b, hsa-miR-134, hsa-miR-135a, hsa-miR-135a*, hsa-miR-135b, hsa-miR-135b*, hsa-miR-136, hsa-miR-136*, hsa-miR-137, hsa-miR-138, hsa-miR-138-1*, hsa-miR-138-2*, hsa-miR-139-3p, hsa-miR-139-5p, hsa-miR-140-3p, hsa-miR-140-5p, hsa-miR-141, hsa-miR-141*, hsa-miR-142-3p, hsa-miR-142-5p, hsa-miR-143, hsa-miR-143*, hsa-miR-144, hsa-miR-144*, hsa-miR-145, hsa-miR-145*, hsa-miR-146a, hsa-miR-146a*, hsa-miR-146b-3p, hsa-miR-146b-5p, hsa-miR-147, hsa-miR-147b, hsa-miR-148a, hsa-miR-148a*, hsa-miR-148b, hsa-miR-148b*, hsa-miR-149, hsa-miR-149*, hsa-miR-150, hsa-miR-150*, hsa-miR-151-3p, hsa-miR-151-5p, hsa-miR-152, hsa-miR-153, hsa-miR-154, hsa-miR-154*, hsa-miR-155, hsa-miR-155*, hsa-miR-15a, hsa-miR-15a*, hsa-miR-15b, hsa-miR-15b*, hsa-miR-16, hsa-miR-16-1*, hsa-miR-16-2*, hsa-miR-17, hsa-miR-17*, hsa-miR-181a, hsa-miR-181a*, hsa-miR-181a-2*, hsa-miR-181b, hsa-miR-181c, hsa-miR-181c*, hsa-miR-181d, hsa-miR-182, hsa-miR-182*, hsa-miR-1825, hsa-miR-1826, hsa-miR-1827, hsa-miR-183, hsa-miR-183*, hsa-miR-184, hsa-miR-185, hsa-miR-185*, hsa-miR-186, hsa-miR-186*, hsa-miR-187, hsa-miR-187*, hsa-miR-188-3p, hsa-miR-188-5p, hsa-miR-18a, hsa-miR-18a*, hsa-miR-18b, hsa-miR-18b*, hsa-miR-190, hsa-miR-190b, hsa-miR-191, hsa-miR-191*, hsa-miR-192, hsa-miR-192*, hsa-miR-193a-3p, hsa-miR-193a-5p, hsa-miR-193b, hsa-miR-193b*, hsa-miR-194, hsa-miR-194*, hsa-miR-195, hsa-miR-195*, hsa-miR-196a, hsa-miR-196a*, hsa-miR-196b, hsa-miR-197, hsa-miR-198, hsa-miR-199a-3p, hsa-miR-199a-5p, hsa-miR-199b-5p, hsa-miR-19a, hsa-miR-19a*, hsa-miR-19b, hsa-miR-19b-1*, hsa-miR-19b-2*, hsa-miR-200a, hsa-miR-200a*, hsa-miR-200b, hsa-miR-200b*, hsa-miR-200c, hsa-miR-200c*, hsa-miR-202, hsa-miR-202*, hsa-miR-203, hsa-miR-204, hsa-miR-205, hsa-miR-206, hsa-miR-208a, hsa-miR-208b, hsa-miR-20a, hsa-miR-20a*, hsa-miR-20b, hsa-miR-20b*, hsa-miR-21, hsa-miR-21*, hsa-miR-210, hsa-miR-211, hsa-miR-212, hsa-miR-214, hsa-miR-214*, hsa-miR-215, hsa-miR-216a, hsa-miR-216b, hsa-miR-217, hsa-miR-218, hsa-miR-218-1*, hsa-miR-218-2*, hsa-miR-219-1-3p, hsa-miR-219-2-3p, hsa-miR-219-5p, hsa-miR-22, hsa-miR-22*, hsa-miR-220a, hsa-miR-220b, hsa-miR-220c, hsa-miR-221, hsa-miR-221*, hsa-miR-222, hsa-miR-222*, hsamiR-223, hsa-miR-223*, hsa-miR-224, hsa-miR-23a, hsa-miR-23a*, hsa-miR-23b, hsa-miR-23b*, hsa-miR-24, hsa-miR-24-1*, hsa-miR-24-2*, hsa-miR-25, hsa-miR-25*, hsa-miR-26a, hsa-miR-26a-1*, hsa-miR-26a-2*, hsa-miR-26b, hsa-miR-26b*, hsa-miR-27a, hsa-miR-27a*, hsa-miR-27b, hsa-miR-27b*, hsa-miR-28-3p, hsa-miR-28-5p, hsa-miR-296-3p, hsa-miR-296-5p, hsa-miR-297, hsa-miR-298, hsa-miR-299-3p, hsa-miR-299-5p, hsa-miR-29a, hsa-miR-29a*, hsa-miR-29b, hsa-miR-296-1*, hsa-miR-296-2*, hsa-miR-29c, hsa-miR-29c*, hsa-miR-300, hsa-miR-301a, hsa-miR-301b, hsa-miR-302a, hsa-miR-302a*, hsa-miR-302b, hsa-miR-302b*, hsa-miR-302c, hsa-miR-302c*, hsa-miR-302d, hsa-miR-302d*, hsa-miR-302e, hsa-miR-302f, hsa-miR-30a, hsa-miR-30a*, hsa-miR-30b, hsa-miR-30b*, hsa-miR-30c, hsa-miR-30c-1*, hsa-miR-30c-2*, hsa-miR-30d, hsa-miR-30d*, hsa-miR-30e, hsa-miR-30e*, hsa-miR-31, hsa-miR-31*, hsa-miR-32, hsa-miR-32*, hsa-miR-320a, hsa-miR-320b, hsa-miR-320c, hsa-miR-320d, hsa-miR-323-3p, hsa-miR-323-5p, hsa-miR-324-3p, hsa-miR-324-5p, hsa-miR-325, hsa-miR-326, hsa-miR-328, hsa-miR-329, hsa-miR-330-3p, hsa-miR-330-5p, hsa-miR-331-3p, hsa-miR-331-5p, hsa-miR-335, hsa-miR-335*, hsa-miR-337-3p, hsa-miR-337-5p, hsa-miR-338-3p, hsa-miR-338-5p, hsa-miR-339-3p, hsa-miR-339-5p, hsa-miR-33a, hsa-miR-33a*, hsa-miR-33b, hsa-miR-33b*, hsa-miR-340, hsa-miR-340*, hsa-miR-342-3p, hsa-miR-342-5p, hsa-miR-345, hsa-miR-346, hsa-miR-34a, hsa-miR-34a*, hsa-miR-34b, hsa-miR-34b*, hsa-miR-34c-3p, hsa-miR-34c-5p, hsa-miR-361-3p, hsa-miR-361-5p, hsa-miR-362-3p, hsa-miR-362-5p, hsa-miR-363, hsa-miR-363*, hsa-miR-365, hsa-miR-367, hsa-miR-367*, hsa-miR-369-3p, hsa-miR-369-5p, hsa-miR-370, hsa-miR-371-3p, hsa-miR-371-5p, hsa-miR-372, hsa-miR-373, hsa-miR-373*, hsa-miR-374a, hsa-miR-374a*, hsa-miR-374b, hsa-miR-374b*, hsa-miR-375, hsa-miR-376a, hsa-miR-376a*, hsa-miR-376b, hsa-miR-376c, hsa-miR-377, hsa-miR-377*, hsa-miR-378, hsa-miR-378*, hsa-miR-379, hsa-miR-379*, hsa-miR-380, hsa-miR-380*, hsa-miR-381, hsa-miR-382, hsa-miR-383, hsa-miR-384, hsa-miR-409-3p, hsa-miR-409-5p, hsa-miR-410, hsa-miR-411, hsa-miR-411*, hsa-miR-412, hsa-miR-421, hsa-miR-422a, hsa-miR-423-3p, hsa-miR-423-5p, hsa-miR-424, hsa-miR-424*, hsa-miR-425, hsa-miR-425*, hsa-miR-429, hsa-miR-431, hsa-miR-431*, hsa-miR-432, hsa-miR-432*, hsa-miR-433, hsa-miR-448, hsa-miR-449a, hsa-miR-449b, hsa-miR-450a, hsa-miR-450b-3p, hsa-miR-450b-5p, hsa-miR-451, hsa-miR-452, hsa-miR-452*, hsa-miR-453, hsa-miR-454, hsa-miR-454*, hsa-miR-455-3p, hsa-miR-455-5p, hsa-miR-483-3p, hsa-miR-483-5p, hsa-miR-484, hsa-miR-485-3p, hsa-miR-485-5p, hsa-miR-486-3p, hsa-miR-486-5p, hsa-miR-487a, hsa-miR-487b, hsa-miR-488, hsa-miR-488*, hsa-miR-489, hsa-miR-490-3p, hsa-miR-490-5p, hsa-miR-491-3p, hsa-miR-491-5p, hsa-miR-492, hsa-miR-493, hsa-miR-493*, hsa-miR-494, hsa-miR-495, hsa-miR-496, hsa-miR-497, hsa-miR-497*, hsa-miR-498, hsa-miR-499-3p, hsa-miR-499-5p, hsa-miR-500, hsa-miR-500*, hsa-miR-501-3p, hsa-miR-501-5p, hsa-miR-502-3p, hsa-miR-502-5p, hsa-miR-503, hsa-miR-504, hsa-miR-505, hsa-miR-505*, hsa-miR-506, hsa-miR-507, hsa-miR-508-3p, hsa-miR-508-5p, hsa-miR-509-3-5p, hsa-miR-509-3p, hsa-miR-509-5p, hsa-miR-510, hsa-miR-511, hsa-miR-512-3p, hsa-miR-512-5p, hsa-miR-513a-3p, hsa-miR-513a-5p, hsa-miR-513b, hsa-miR-513c, hsa-miR-514, hsa-miR-515-3p, hsa-miR-515-5p, hsa-miR-516a-3p, hsa-miR-516a-5p, hsa-miR-516b, hsa-miR-517*, hsa-miR-517a, hsa-miR-517b, hsa-miR-517c, hsa-miR-518a-3p, hsa-miR-518a-5p, hsa-miR-518b, hsa-miR-518c, hsa-miR-518c*, hsa-miR-518d-3p, hsa-miR-518d-5p, hsa-miR-518e, hsa-miR-518e*, hsa-miR-518f, hsa-miR-518f*, hsa-miR-519a, hsa-miR-519b-3p, hsa-miR-519c-3p, hsa-miR-519d, hsa-miR-519e, hsa-miR-519e*, hsa-miR-520a-3p, hsa-miR-520a-5p, hsa-miR-520b, hsa-miR-520c-3p, hsa-miR-520d-3p, hsa-miR-520d-5p, hsa-miR-520e, hsa-miR-520f, hsa-miR-520g, hsa-miR-520h, hsa-miR-521, hsa-miR-522, hsa-miR-523, hsa-miR-524-3p, hsa-miR-524-5p, hsa-miR-525-3p, hsa-miR-525-5p, hsa-miR-526b, hsa-miR-526b*, hsa-miR-532-3p, hsa-miR-532-5p, hsa-miR-539, hsa-miR-541, hsa-miR-541*, hsa-miR-542-3p, hsa-miR-542-5p, hsa-miR-543, hsa-miR-544, hsa-miR-545, hsa-miR-545*, hsa-miR-548a-3p, hsa-miR-548a-5p, hsa-miR-548b-3p, hsa-miR-5486-5p, hsa-miR-548c-3p, hsa-miR-548c-5p, hsa-miR-548d-3p, hsa-miR-548d-5p, hsa-miR-548e, hsa-miR-548f, hsa-miR-548g, hsa-miR-548h, hsa-miR-548i, hsa-miR-548j, hsa-miR-548k, hsa-miR-5481, hsa-miR-548m, hsa-miR-548n, hsa-miR-548o, hsa-miR-548p, hsa-miR-549, hsa-miR-550, hsa-miR-550*, hsa-miR-551a, hsa-miR-551b, hsa-miR-551b*, hsa-miR-552, hsa-miR-553, hsa-miR-554, hsa-miR-555, hsa-miR-556-3p, hsa-miR-556-5p, hsa-miR-557, hsa-miR-558, hsa-miR-559, hsa-miR-561, hsa-miR-562, hsa-miR-563, hsa-miR-564, hsa-miR-566, hsa-miR-567, hsa-miR-568, hsa-miR-569, hsa-miR-570, hsa-miR-571, hsa-miR-572, hsa-miR-573, hsa-miR-574-3p, hsa-miR-574-5p, hsa-miR-575, hsa-miR-576-3p, hsa-miR-576-5p, hsa-miR-577, hsa-miR-578, hsa-miR-579, hsa-miR-580, hsa-miR-581, hsa-miR-582-3p, hsa-miR-582-5p, hsa-miR-583, hsa-miR-584, hsa-miR-585, hsa-miR-586, hsa-miR-587, hsa-miR-588, hsa-miR-589, hsa-miR-589*, hsa-miR-590-3p, hsa-miR-590-5p, hsa-miR-591, hsa-miR-592, hsa-miR-593, hsa-miR-593*, hsa-miR-595, hsa-miR-596, hsa-miR-597, hsa-miR-598, hsa-miR-599, hsa-miR-600, hsa-miR-601, hsa-miR-602, hsa-miR-603, hsa-miR-604, hsa-miR-605, hsa-miR-606, hsa-miR-607, hsa-miR-608, hsa-miR-609, hsa-miR-610, hsa-miR-611, hsa-miR-612, hsa-miR-613, hsa-miR-614, hsa-miR-615-3p, hsa-miR-615-5p, hsa-miR-616, hsa-miR-616*, hsa-miR-617, hsa-miR-618, hsa-miR-619, hsa-miR-620, hsa-miR-621, hsa-miR-622, hsa-miR-623, hsa-miR-624, hsa-miR-624*, hsa-miR-625, hsa-miR-625*, hsa-miR-626, hsa-miR-627, hsa-miR-628-3p, hsa-miR-628-5p, hsa-miR-629, hsa-miR-629*, hsa-miR-630, hsa-miR-631, hsa-miR-632, hsa-miR-633, hsa-miR-634, hsa-miR-635, hsa-miR-636, hsa-miR-637, hsa-miR-638, hsa-miR-639, hsa-miR-640, hsa-miR-641, hsa-miR-642, hsa-miR-643, hsa-miR-644, hsa-miR-645, hsa-miR-646, hsa-miR-647, hsa-miR-648, hsa-miR-649, hsa-miR-650, hsa-miR-651, hsa-miR-652, hsa-miR-653, hsa-miR-654-3p, hsa-miR-654-5p, hsa-miR-655, hsa-miR-656, hsa-miR-657, hsa-miR-658, hsa-miR-659, hsa-miR-660, hsa-miR-661, hsa-miR-662, hsa-miR-663, hsa-miR-663b, hsa-miR-664, hsa-miR-664*, hsa-miR-665, hsa-miR-668, hsa-miR-671-3p, hsa-miR-671-5p, hsa-miR-675, hsa-miR-7, hsa-miR-708, hsa-miR-708*, hsa-miR-7-1*, hsa-miR-7-2*, hsa-miR-720, hsa-miR-744, hsa-miR-744*, hsa-miR-758, hsa-miR-760, hsa-miR-765, hsa-miR-766, hsa-miR-767-3p, hsa-miR-767-5p, hsa-miR-768-3p, hsa-miR-768-5p, hsa-miR-769-3p, hsa-miR-769-5p, hsa-miR-770-5p, hsa-miR-802, hsa-miR-873, hsa-miR-874, hsa-miR-875-3p, hsa-miR-875-5p, hsa-miR-876-3p, hsa-miR-876-5p, hsa-miR-877, hsa-miR-877*, hsa-miR-885-3p, hsa-miR-885-5p, hsa-miR-886-3p, hsa-miR-886-5p, hsa-miR-887, hsa-miR-888, hsa-miR-888*, hsa-miR-889, hsa-miR-890, hsa-miR-891a, hsa-miR-891b, hsa-miR-892a, hsa-miR-892b, hsa-miR-9, hsa-miR-9*, hsa-miR-920, hsa-miR-921, hsa-miR-922, hsa-miR-923, hsa-miR-924, hsa-miR-92a, hsa-miR-92a-1*, hsa-miR-92a-2*, hsa-miR-92b, hsa-miR-92b*, hsa-miR-93, hsa-miR-93*, hsa-miR-933, hsa-miR-934, hsa-miR-935, hsa-miR-936, hsa-miR-937, hsa-miR-938, hsamiR-939, hsa-miR-940, hsa-miR-941, hsa-miR-942, hsa-miR-943, hsa-miR-944, hsa-miR-95, hsa-miR-96, hsa-miR-96*, hsa-miR-98, hsa-miR-99a, hsa-miR-99a*, hsa-miR-99b, and hsa-miR-99b*.

A miRNA inhibits the function of the mRNAs it targets and, as a result, inhibits expression of the polypeptides encoded by the mRNAs. Thus, blocking (partially or totally) the activity of the miRNA (e.g., silencing the miRNA) can effectively induce, or restore, expression of a polypeptide whose expression is inhibited (derepress the polypeptide). In one embodiment, derepression of polypeptides encoded by mRNA targets of a miRNA is accomplished by inhibiting the miRNA activity in cells through any one of a variety of methods. For example, blocking the activity of a miRNA can be accomplished by hybridization with a small interfering nucleic acid (e.g., antisense oligonucleotide, miRNA sponge, TuD RNA) that is complementary, or substantially complementary to, the miRNA, thereby blocking interaction of the miRNA with its target mRNA. As used herein, an small interfering nucleic acid that is substantially complementary to a miRNA is one that is capable of hybridizing with a miRNA, and blocking the miRNA's activity. In some embodiments, an small interfering nucleic acid that is substantially complementary to a miRNA is an small interfering nucleic acid that is complementary with the miRNA at all but 1, 2, 3, 4, 5, 6, 7, 8, 9, 10, 11, 12, 13, 14, 15, 16, 17, or 18 bases. In some embodiments, an small interfering nucleic acid sequence that is substantially complementary to a miRNA, is an small interfering nucleic acid sequence that is complementary with the miRNA at, at least, one base.

A "miRNA Inhibitor" is an agent that blocks miRNA function, expression and/or processing. For instance, these molecules include but are not limited to microRNA specific antisense, microRNA sponges, tough decoy RNAs (TuD RNAs) and microRNA oligonucleotides (double-stranded, hairpin, short oligonucleotides) that inhibit miRNA interaction with a Drosha complex. MicroRNA inhibitors can be expressed in cells from a transgenes of a rAAV vector, as discussed above. MicroRNA sponges specifically inhibit miRNAs through a complementary heptameric seed sequence (Ebert, M. S, Nature Methods, Epub Aug. 12, 2007). In some embodiments, an entire family of miRNAs can be silenced using a single sponge sequence. TuD RNAs achieve efficient and long-term-suppression of specific miRNAs in mammalian cells (See, e.g., Takeshi Haraguchi, et al., Nucleic Acids Research, 2009, Vol. 37, No. 6 e43, the contents of which relating to TuD RNAs are incorporated herein by reference). Other methods for silencing miRNA function (derepression of miRNA targets) in cells will be apparent to one of ordinary skill in the art.

In some embodiments, the cloning capacity of the recombinant RNA vector may limited and a desired coding sequence may require the complete replacement of the virus's 4.8 kilobase genome. Large genes may, therefore, not be suitable for use in a standard recombinant AAV vector, in some cases. The skilled artisan will appreciate that options are available in the art for overcoming a limited coding capacity. For example, the AAV ITRs of two genomes can anneal to form head to tail concatamers, almost doubling the capacity of the vector. Insertion of splice sites allows for the removal of the ITRs from the transcript. Other options for overcoming a limited cloning capacity will be apparent to the skilled artisan.

Somatic Transgenic Animal Models Produced Using rAAV-Based Gene Transfer

The invention also involves the production of somatic transgenic animal models of disease using recombinant Adeno-Associated Virus (rAAV) based methods. The methods are based, at least in part, on the observation that AAV serotypes and variants thereof mediate efficient and stable gene transfer in a tissue specific manner in adult animals. The rAAV elements (capsid, promoter, transgene products) are combined to achieve somatic transgenic animal models that express a stable transgene in a time and tissue specific manner. The somatic transgenic animal produced by the methods of the invention can serve as useful models of human disease, pathological state, and/or to characterize the effects of gene for which the function (e.g., tissue specific, disease role) is unknown or not fully understood. For example, an animal (e.g., mouse) can be infected at a distinct developmental stage (e.g., age) with a rAAV comprising a capsid having a specific tissue targeting capability (e.g., liver, heart, pancreas) and a transgene having a tissue specific promoter driving expression of a gene involved in disease. Upon infection, the rAAV infects distinct cells of the target tissue and produces the product of the transgene.

In some embodiments, the sequence of the coding region of a transgene is modified. The modification may alter the function of the product encoded by the transgene. The effect of the modification can then be studied in vivo by generating a somatic transgenic animal model using the methods disclosed herein. In some embodiments, modification of the sequence of coding region is a nonsense mutation that results in a fragment (e.g., a truncated version). In other cases, the modification is a missense mutation that results in an amino acid substitution. Other modifications are possible and will be apparent to the skilled artisan.

In some embodiments, the transgene causes a pathological state. A transgene that causes a pathological state is a gene whose product has a role in a disease or disorder (e.g., causes the disease or disorder, makes the animal susceptible to the disease or disorder) and/or may induce the disease or disorder in the animal. The animal can then be observed to evaluate any number of aspects of the disease (e.g., progression, response to treatment, etc). These examples are not meant to be limiting, other aspects and examples are disclosed herein and described in more detail below.

The invention in some aspects, provide methods for producing somatic transgenic animal models through the targeted destruction of specific cell types. For example, models of type 1 diabetes can be produced by the targeted destruction of pancreatic Beta-islets. In other examples, the targeted destruction of specific cell types can be used to evaluate the role of specific cell types on human disease. In this regard, transgenes that encode cellular toxins (e.g., diphtheria toxin A (DTA)) or pro-apoptotic genes (NTR, Box, etc.) can be useful as transgenes for functional ablation of specific cell types. Other exemplary transgenes, whose products kill cells are embraced by the methods disclosed herein and will be apparent to one of ordinary skill in the art.

The invention in some aspects, provides methods for producing somatic transgenic animal models to study the long-term effects of over-expression or knockdown of genes. The long term over expression or knockdown (e.g., by shRNA, miRNA, miRNA inhibitor, etc.) of genes in specific target tissues can disturb normal metabolic balance and establish a pathological state, thereby producing an animal model of a disease, such as, for example, cancer. The invention in some aspects, provides methods for producing somatic transgenic animal models to study the long-term effects of over-expression or knockdown of gene of potential oncogenes and other genes to study tumorigenesis and gene function in the targeted tissues. Useful transgene products include proteins that are known to be associated with cancer and small interfering nucleic acids inhibiting the expression of such proteins. Other suitable transgenes may be readily selected by one of skill in the art provided that they are useful for creating animal models of tissue-specific pathological state and/or disease.

Recombinant AAV Administration Methods

The rAAVs may be delivered to a subject in compositions according to any appropriate methods known in the art. The rAAV, preferably suspended in a physiologically compatible carrier (i.e., in a composition), may be administered to a subject, i.e. host animal, such as a human, mouse, rat, cat, dog, sheep, rabbit, horse, cow, goat, pig, guinea pig, hamster, chicken, turkey, or a non-human primate (e.g, Macaque). In some embodiments a host animal does not include a human.

Delivery of the rAAVs to a mammalian subject may be by, for example, intramuscular injection or by administration into the bloodstream of the mammalian subject. Administration into the bloodstream may be by injection into a vein, an artery, or any other vascular conduit. In some embodiments, the rAAVs are administered into the bloodstream by way of isolated limb perfusion, a technique well known in the surgical arts, the method essentially enabling the artisan to isolate a limb from the systemic circulation prior to administration of the rAAV virions. A variant of the isolated limb perfusion technique, described in U.S. Pat. No. 6,177,403, can also be employed by the skilled artisan to administer the virions into the vasculature of an isolated limb to potentially enhance transduction into muscle cells or tissue. Moreover, in certain instances, it may be desirable to deliver the virions to the CNS of a subject. By "CNS" is meant all cells and tissue of the brain and spinal cord of a vertebrate. Thus, the term includes, but is not limited to, neuronal cells, glial cells, astrocytes, cereobrospinal fluid (CSF), interstitial spaces, bone, cartilage and the like. Recombinant AAVs may be delivered directly to the CNS or brain by injection into, e.g., the ventricular region, as well as to the striatum (e.g., the caudate nucleus or putamen of the striatum), spinal cord and neuromuscular junction, or cerebellar lobule, with a needle, catheter or related device, using neurosurgical techniques known in the art, such as by stereotactic injection (see, e.g., Stein et al., J Virol 73:3424-3429, 1999; Davidson et al., PNAS 97:3428-3432, 2000; Davidson et al., Nat. Genet. 3:219-223, 1993; and Alisky and Davidson, Hum. Gene Ther. 11:2315-2329, 2000).

The compositions of the invention may comprise an rAAV alone, or in combination with one or more other viruses (e.g., a second rAAV encoding having one or more different transgenes). In some embodiments, a composition comprises 1, 2, 3, 4, 5, 6, 7, 8, 9, 10, or more different rAAVs each having one or more different transgenes.

Suitable carriers may be readily selected by one of skill in the art in view of the indication for which the rAAV is directed. For example, one suitable carrier includes saline, which may be formulated with a variety of buffering solutions (e.g., phosphate buffered saline). Other exemplary carriers include sterile saline, lactose, sucrose, calcium phosphate, gelatin, dextran, agar, pectin, peanut oil, sesame oil, and water. The selection of the carrier is not a limitation of the present invention.

Optionally, the compositions of the invention may contain, in addition to the rAAV and carrier(s), other conventional pharmaceutical ingredients, such as preservatives, or chemical stabilizers. Suitable exemplary preservatives include chlorobutanol, potassium sorbate, sorbic acid, sulfur dioxide, propyl gallate, the parabens, ethyl vanillin, glycerin, phenol, and parachlorophenol. Suitable chemical stabilizers include gelatin and albumin.

The rAAVS are administered in sufficient amounts to transfect the cells of a desired tissue and to provide sufficient levels of gene transfer and expression without undue adverse effects. Conventional and pharmaceutically acceptable routes of administration include, but are not limited to, direct delivery to the selected organ (e.g., intraportal delivery to the liver), oral, inhalation (including intranasal and intratracheal delivery), intraocular, intravenous, intramuscular, subcutaneous, intradermal, intratumoral, and other parental routes of administration. Routes of administration may be combined, if desired.

The dose of rAAV virions required to achieve a particular "therapeutic effect," e.g., the units of dose in genome copies/per kilogram of body weight (GC/kg), will vary based on several factors including, but not limited to: the route of rAAV virion administration, the level of gene or RNA expression required to achieve a therapeutic effect, the specific disease or disorder being treated, and the stability of the gene or RNA product. One of skill in the art can readily determine a rAAV virion dose range to treat a patient having a particular disease or disorder based on the aforementioned factors, as well as other factors that are well known in the art.

An effective amount of an rAAV is an amount sufficient to target infect an animal, target a desired tissue. In some embodiments, an effective amount of an rAAV is an amount sufficient to produce a stable somatic transgenic animal model. The effective amount will depend primarily on factors such as the species, age, weight, health of the subject, and the tissue to be targeted, and may thus vary among animal and tissue. For example, a effective amount of the rAAV is generally in the range of from about 1 ml to about 100 ml of solution containing from about $10^9$ to $10^{16}$ genome copies. In some cases, a dosage between about $10^{11}$ to $10^{12}$ rAAV genome copies is appropriate. In certain embodiments, $10^{12}$ rAAV genome copies is effective to target heart, liver, and pancreas tissues. In some cases, stable transgenic animals are produced by multiple doses of an rAAV.

In some embodiments, rAAV compositions are formulated to reduce aggregation of AAV particles in the composition, particularly where high rAAV concentrations are present (e.g., ~$10^{13}$ GC/ml or more). Methods for reducing aggregation of rAAVs are well known in the art and, include, for example, addition of surfactants, pH adjustment, salt concentration adjustment, etc. (See, e.g., Wright F R, et al., Molecular Therapy (2005) 12, 171-178, the contents of which are incorporated herein by reference.)

Formulation of pharmaceutically-acceptable excipients and carrier solutions is well-known to those of skill in the art, as is the development of suitable dosing and treatment regimens for using the particular compositions described herein in a variety of treatment regimens.

Typically, these formulations may contain at least about 0.1% of the active compound or more, although the percentage of the active ingredient(s) may, of course, be varied and may conveniently be between about 1 or 2% and about 70% or 80% or more of the weight or volume of the total formulation. Naturally, the amount of active compound in each therapeutically-useful composition may be prepared is such a way that a suitable dosage will be obtained in any given unit dose of the compound. Factors such as solubility, bioavailability, biological half-life, route of administration, product shelf life, as well as other pharmacological considerations will be contemplated by one skilled in the art of preparing such pharmaceutical formulations, and as such, a variety of dosages and treatment regimens may be desirable.

In certain circumstances it will be desirable to deliver the rAAV-based therapeutic constructs in suitably formulated pharmaceutical compositions disclosed herein either subcutaneously, intraopancreatically, intranasally, parenterally, intravenously, intramuscularly, intrathecally, or orally, intraperitoneally, or by inhalation. In some embodiments, the administration modalities as described in U.S. Pat. Nos. 5,543,158; 5,641,515 and 5,399,363 (each specifically incorporated herein by reference in its entirety) may be used to deliver rAAVs. In some embodiments, a preferred mode of administration is by portal vein injection.

The pharmaceutical forms suitable for injectable use include sterile aqueous solutions or dispersions and sterile powders for the extemporaneous preparation of sterile injectable solutions or dispersions. Dispersions may also be prepared in glycerol, liquid polyethylene glycols, and mixtures thereof and in oils. Under ordinary conditions of storage and use, these preparations contain a preservative to prevent the growth of microorganisms. In many cases the form is sterile and fluid to the extent that easy syringability exists. It must be stable under the conditions of manufacture and storage and must be preserved against the contaminating action of microorganisms, such as bacteria and fungi. The carrier can be a solvent or dispersion medium containing, for example, water, ethanol, polyol (e.g., glycerol, propylene glycol, and liquid polyethylene glycol, and the like), suitable mixtures thereof, and/or vegetable oils. Proper fluidity may be maintained, for example, by the use of a coating, such as lecithin, by the maintenance of the required particle size in the case of dispersion and by the use of surfactants. The prevention of the action of microorganisms can be brought about by various antibacterial and antifungal agents, for example, parabens, chlorobutanol, phenol, sorbic acid, thimerosal, and the like. In many cases, it will be preferable to include isotonic agents, for example, sugars or sodium chloride. Prolonged absorption of the injectable compositions can be brought about by the use in the compositions of agents delaying absorption, for example, aluminum monostearate and gelatin.

For administration of an injectable aqueous solution, for example, the solution may be suitably buffered, if necessary, and the liquid diluent first rendered isotonic with sufficient saline or glucose. These particular aqueous solutions are especially suitable for intravenous, intramuscular, subcutaneous and intraperitoneal administration. In this connection, a sterile aqueous medium that can be employed will be known to those of skill in the art. For example, one dosage may be dissolved in 1 ml of isotonic NaCl solution and either added to 1000 ml of hypodermoclysis fluid or injected at the proposed site of infusion, (see for example, "Remington's Pharmaceutical Sciences" 15th Edition, pages 1035-1038 and 1570-1580). Some variation in dosage will necessarily occur depending on the condition of the host. The person responsible for administration will, in any event, determine the appropriate dose for the individual host.

Sterile injectable solutions are prepared by incorporating the active rAAV in the required amount in the appropriate solvent with various of the other ingredients enumerated herein, as required, followed by filtered sterilization. Generally, dispersions are prepared by incorporating the various sterilized active ingredients into a sterile vehicle which contains the basic dispersion medium and the required other ingredients from those enumerated above. In the case of sterile powders for the preparation of sterile injectable solutions, the preferred methods of preparation are vacuum-drying and freeze-drying techniques which yield a powder of the active ingredient plus any additional desired ingredient from a previously sterile-filtered solution thereof.

The rAAV compositions disclosed herein may also be formulated in a neutral or salt form. Pharmaceutically-acceptable salts, include the acid addition salts (formed with the free amino groups of the protein) and which are formed with inorganic acids such as, for example, hydrochloric or phosphoric acids, or such organic acids as acetic, oxalic, tartaric, mandelic, and the like. Salts formed with the free carboxyl groups can also be derived from inorganic bases such as, for example, sodium, potassium, ammonium, calcium, or ferric hydroxides, and such organic bases as isopropylamine, trimethylamine, histidine, procaine and the like. Upon formulation, solutions will be administered in a manner compatible with the dosage formulation and in such amount as is therapeutically effective. The formulations are easily administered in a variety of dosage forms such as injectable solutions, drug-release capsules, and the like.

As used herein, "carrier" includes any and all solvents, dispersion media, vehicles, coatings, diluents, antibacterial and antifungal agents, isotonic and absorption delaying agents, buffers, carrier solutions, suspensions, colloids, and the like. The use of such media and agents for pharmaceutical active substances is well known in the art. Supplementary active ingredients can also be incorporated into the compositions. The phrase "pharmaceutically-acceptable" refers to molecular entities and compositions that do not produce an allergic or similar untoward reaction when administered to a host.

Delivery vehicles such as liposomes, nanocapsules, microparticles, microspheres, lipid particles, vesicles, and the like, may be used for the introduction of the compositions of the present invention into suitable host cells. In particular, the rAAV vector delivered trangenes may be formulated for delivery either encapsulated in a lipid particle, a liposome, a vesicle, a nanosphere, or a nanoparticle or the like.

Such formulations may be preferred for the introduction of pharmaceutically acceptable formulations of the nucleic acids or the rAAV constructs disclosed herein. The formation and use of liposomes is generally known to those of skill in the art. Recently, liposomes were developed with improved serum stability and circulation half-times (U.S. Pat. No. 5,741,516). Further, various methods of liposome and liposome like preparations as potential drug carriers have been described (U.S. Pat. Nos. 5,567,434; 5,552,157; 5,565,213; 5,738,868 and 5,795,587).

Liposomes have been used successfully with a number of cell types that are normally resistant to transfection by other procedures. In addition, liposomes are free of the DNA length constraints that are typical of viral-based delivery systems. Liposomes have been used effectively to introduce genes, drugs, radiotherapeutic agents, viruses, transcription factors and allosteric effectors into a variety of cultured cell lines and animals. In addition, several successful clinical trails examining the effectiveness of liposome-mediated drug delivery have been completed.

Liposomes are formed from phospholipids that are dispersed in an aqueous medium and spontaneously form multilamellar concentric bilayer vesicles (also termed multilamellar vesicles (MLVs). MLVs generally have diameters of from 25 nm to 4 µm. Sonication of MLVs results in the formation of small unilamellar vesicles (SUVs) with diameters in the range of 200 to 500 .ANG., containing an aqueous solution in the core.

Alternatively, nanocapsule formulations of the rAAV may be used. Nanocapsules can generally entrap substances in a stable and reproducible way. To avoid side effects due to intracellular polymeric overloading, such ultrafine particles (sized around 0.1 µm) should be designed using polymers able to be degraded in vivo. Biodegradable polyalkyl-cyanoacrylate nanoparticles that meet these requirements are contemplated for use.

In addition to the methods of delivery described above, the following techniques are also contemplated as alternative methods of delivering the rAAV compositions to a host. Sonophoresis (ie., ultrasound) has been used and described in U.S. Pat. No. 5,656,016 as a device for enhancing the rate and efficacy of drug permeation into and through the circulatory system. Other drug delivery alternatives contemplated are intraosseous injection (U.S. Pat. No. 5,779,708), microchip devices (U.S. Pat. No. 5,797,898), ophthalmic formulations (Bourlais et al., 1998), transdermal matrices (U.S. Pat. Nos. 5,770,219 and 5,783,208) and feedback-controlled delivery (U.S. Pat. No. 5,697,899).

Kits and Related Compositions

The agents described herein may, in some embodiments, be assembled into pharmaceutical or diagnostic or research kits to facilitate their use in therapeutic, diagnostic or research applications. A kit may include one or more containers housing the components of the invention and instructions for use. Specifically, such kits may include one or more agents described herein, along with instructions describing the intended application and the proper use of these agents. In certain embodiments agents in a kit may be in a pharmaceutical formulation and dosage suitable for a particular application and for a method of administration of the agents. Kits for research purposes may contain the components in appropriate concentrations or quantities for running various experiments.

The kit may be designed to facilitate use of the methods described herein by researchers and can take many forms. Each of the compositions of the kit, where applicable, may be provided in liquid form (e.g., in solution), or in solid form, (e.g., a dry powder). In certain cases, some of the compositions may be constitutable or otherwise processable (e.g., to an active form), for example, by the addition of a suitable solvent or other species (for example, water or a cell culture medium), which may or may not be provided with the kit. As used herein, "instructions" can define a component of instruction and/or promotion, and typically involve written instructions on or associated with packaging of the invention. Instructions also can include any oral or electronic instructions provided in any manner such that a user will clearly recognize that the instructions are to be associated with the kit, for example, audiovisual (e.g., videotape, DVD, etc.), Internet, and/or web-based communications, etc. The written instructions may be in a form prescribed by a governmental agency regulating the manufacture, use or sale of pharmaceuticals or biological products, which instructions can also reflects approval by the agency of manufacture, use or sale for animal administration.

The kit may contain any one or more of the components described herein in one or more containers. As an example, in one embodiment, the kit may include instructions for mixing one or more components of the kit and/or isolating and mixing a sample and applying to a subject. The kit may include a container housing agents described herein. The agents may be in the form of a liquid, gel or solid (powder). The agents may be prepared sterilely, packaged in syringe and shipped refrigerated. Alternatively it may be housed in a vial or other container for storage. A second container may have other agents prepared sterilely. Alternatively the kit may include the active agents premixed and shipped in a syringe, vial, tube, or other container. The kit may have one or more or all of the components required to administer the agents to an animal, such as a syringe, topical application devices, or iv needle tubing and bag, particularly in the case of the kits for producing specific somatic animal models.

PCR-Based Methods for Identifying Novel AAV Sequences and Related Kits

Exemplary methods used for identifying novel AAV sequences are set forth below. Typically, the nucleic acids are used as primers in reverse transcription and/or polymerase chain reactions in the methods. Examples of primers useful in a reverse transcription reaction include OligodT, random hexamers, and the sequence specific primers disclosed herein (e.g., SEQ ID NO 1, SEQ ID NO: 2, SEQ ID NO: 3, SEQ ID NO: 4). Other primers appropriate for a reverse transcription reaction are known in the art. Nucleic acids which are useful as PCR primers may have a sequence that has substantial homology with a nucleic acid sequence of a region that is highly conserved between at least two AAV serotypes. In some cases, the region is highly conserved between two, three, four, five, six, seven, eight, nine, ten, eleven, or twelve or more AAV serotypes. Typically, the region that is highly conserved covers an end-to-end length of between 25 and 250 bp. In specific cases, the region covers about 150 bp. However, in other cases the end-to-end length of the highly conserved region is greater that 250 bp. Preferably, the region is highly conserved within this end-to-end length over at least about 9, and more preferably, at least 18 base pairs (bp). However, the region may be conserved over more than 18 bp, more than 25 bp, more than 30 bp, or more than 50 bp.

In some embodiments the primers have a sequence as set forth in Table 1.

TABLE 1

| AAV CAP GENE PRIMERS | | |
|---|---|---|
| SEQ ID | | NUCLEIC ACID SEQUENCE |
| SEQ ID NO: 1 | CapF-X | (A/G/C/T/absent)GA(C/T)TG(C/T)(A/G/C)(A/T)(C/T/A)(A/T)(C/T)(G/T)GA(A/G)CAATAAATGA(A/G/C/T/absent) |
| SEQ ID NO: 1 - CapF-X (single letter code) | | NGAYTGYVWHWYKGARCAATAAATGAN |
| SEQ ID NO: 2 | CapR-X | (A/G/C/T/absent)GAAACGAAT(C/A/T)AA(C/A)CGGTTTATTGATTAA(A/G/C/T/absent) |
| SEQ ID NO: 2 - CapR-X (single letter code) | | NGAAACGAATHAAMCGGTTTATTGATTAAN |
| SEQ ID NO: 3 | CapF | GACTGTGTTTCTGAGCAATAAATGA |
| SEQ ID NO: 4 | CapR | GAAACGAATTAACCGGTTTATTGATTAA |

TABLE 1-continued

AAV CAP GENE PRIMERS

| SEQ ID | | NUCLEIC ACID SEQUENCE |
|---|---|---|
| SEQ ID NO: 5 | CapF22-X | (A/G/C/T/absent)(C/T)(C/A)(A/G)(T/A)(C/A)(A/G)(A/T)C(G/T)(G/T)(G/C)AGA(A/C)GCGG(A/G)(A/C)(G/C)(A/G/C/T/absent) |
| SEQ ID NO: 5 (single letter code) | CapF22-X | NYMRWMRWCKKSAGAMGCGGRMSN |
| SEQ ID NO: 6 | CapF22 | CCATCGACGTCAGACGCGGAAG |
| SEQ ID NO: 7 | CapF64-X | (A/G/C/T/absent)(G/C)(G/C)(C/A/G)GAC(A/G)(G/C)(G/C)T(A/C)(G/C)CA(A/G)(A/T)(A/T)CA(A/G)A(T/C)GT(A/G/C/T/absent) |
| SEQ ID NO: 7 (single letter code) | CapF64-X | NSSVGACRSSTMSCARWWCARAYGTN |
| SEQ ID NO: 8 | CapF64 | GCCGACAGGTACCAAAACAAATGT |
| SEQ ID NO: 8 | CapF201-X | (A/G/C/T/absent)(C/A)(C/T)GG(C/A)(G/A)(T/C)GT(C/G)A(G/A)(A/T)AT(C/T)T(C/G)AA(C/T)C(A/G/C/T/absent) |
| SEQ ID NO: 9 (single letter code) | CapF201-X | NMYGGMRYGTSARWATYTSAAYCN |
| SEQ ID NO: 10 | CapF201 | CCGGCGTGTCAGAATCTCAACC |
| SEQ ID NO: 11 | AV2cas-X | (A/G/C/T/absent)AC(A/G)(C/G/T)(A/G)AGANCCAAAGTTCAACTGA(A/C)ACGA(A/G/C/T/absent) |
| SEQ ID NO: 11 (single letter code) | AV2cas-X | NACRBRAGANCCAAAGTTCAACTGAMACGAN |
| SEQ ID NO: 12 | AV2cas | ACAGGAGACCAAAGTTCAACTGAAACGA |

In some embodiments, the PCR methods comprise a first primer having the sequence as set forth in SEQ ID NO: 1 and a second primer having a sequence as set forth in SEQ ID NO: 2. In some embodiments, the PCR methods of the invention comprise a first primer having the sequence as set forth in SEQ ID NO: 3 and a second primer having a sequence as set forth in SEQ ID NO: 4.

The target sequence obtained in the PCR reaction may be all or a portion of the cDNA In some cases the cDNA is about 50, about 100, about 250, about 500, about 1000, about 2000, about 4000 base pairs in length. In certain cases, the cDNA is approximately 2300 base pairs, approximately 2600 base pairs, or approximately 4700 base pairs in length. However, the invention is not so limited and the actual cDNA length will depend on a variety of factors such as AAV serotype, RT reaction primers, RT reaction condition. In most cases, the cDNA has a length that is sufficient to obtain unique sequence information that can be used to identify the AAV serotype from which the amplified sequences originate.

The target sequence obtained in the PCR reaction may be all or a portion of one or more AAV rep or cap genes, such as VP1, VP2 and VP3. Alternatively, the target sequence obtained in the PCR reaction may be all or a portion of one or more AAV hypervariable regions. In the cases where a portion of a gene (e.g., VP1, VP2, or VP3) is obtained it is understood that the portion will be of a sufficient size and from an appropriate position within the gene (e.g., coding region, variable region) to provide unique sequence information that can be used to identify the AAV serotype from which the amplified sequences originate.

The PCR primers are generated using techniques known to those of skill in the art. Each of the PCR primer sets is composed of a forward primer (i.e., 5' primer) and a reverse primer (i.e., 3' primer). See, e.g., Sambrook J et al. 2000. Molecular Cloning: A Laboratory Manual (Third Edition). The term "primer" refers to an oligonucleotide which provides as a point of initiation of synthesis when placed under conditions (PCR reaction) in which synthesis of a primer extension product which is complementary to a nucleic acid strand is induced. The primer is preferably single stranded. However, if a double stranded primer is utilized, it is treated to separate its strands before being used to prepare extension products. The primers may be about 15 to 30 or more nucleotides, and preferably at least 18 nucleotides. However, for certain applications shorter nucleotides, e.g., 7 to 15 nucleotides are utilized. In certain embodiments, the primers are about 25 nucleotides long (e.g., SEQ ID NO 3 or 4)

The primers are selected to be sufficiently complementary to the different strands of each specific sequence to be amplified such that they hybridize with their respective strands. Typically, hybridization occurs under standard PCR conditions known in the art. Thus, primers having melting temperatures between 50 and 65° C. are normally suitable. However, the invention is not so limited. In addition, the primer sequence need not reflect the exact sequence of the region being amplified. For example, a non-complementary nucleotide fragment may be attached to the 5' end of the primer (e.g., for cloning purposes), with the remainder of the primer sequence being substantially (e.g., completely) complementary to the strand. In some cases, a primer may include a sequence (e.g., 5' sequence) that is not substantially complementary to the target sequence but that facilitates subsequent manipulation of the amplicon (e.g., cDNA). For example, in some cases, a primer may have additional sequence at its 5' end having a unique restriction site that facilitates subsequent digestion by an appropriate restriction enzyme. Methods such as this can be employed to accomplish, for example, a cloning step. Alternatively, non-complementary bases or longer sequences can be interspersed into the primer, provided that the primer sequence has sufficient complementarity with the sequence of the strand to be amplified to hybridize therewith and form a template for synthesis of the extension product of the other primer. Techniques such as these and others disclosed herein are well known in the art and are suitable for use in the methods of the instant invention.

The PCR primers for amplifying the target sequence according to the invention are based upon the highly conserved sequences of two or more aligned sequences (e.g., two or more AAV serotypes). The primers can accommodate less than exact identity among the two or more aligned AAV serotypes at the 5' end or in the middle. However, the sequences at the 3' end of the primers correspond to a region of two or more aligned AAV serotypes in which there is exact identity over at least five, preferably, over at least nine base pairs, and more preferably, over at least 18 base pairs at the 3' end of the primers. Thus, the 3' end of the primers is composed of sequences with 100% identity to the aligned sequences over at least five nucleotides. However, one can optionally utilize one, two, or more degenerate nucleotides at the 3' end of the primer.

Both rep and cap gene transcripts are detected with variable abundances by RNA detection methods (e.g., RT-PCR). The expression of cap gene transcripts and ability to generate cDNA of cap RNA through reverse transcription (RT) using the methods disclosed herein, significantly increase abundance of templates for PCR-based rescue of novel cap sequences from tissues. The methods are useful for isolating novel full length functional cap cDNA sequences. The methods involve the design and selection of oligonucleotide primers for both RT and PCR reactions. As discussed herein, AAV cap gene transcription is directed by AAV p40 promoter which is located in the coding sequence of rep genes. Thus, in some cases, the region between the beginning of p40 RNA transcript and the start codon of capsid VP1 cDNA is a target for the 5' primers to retrieve the intact 5' end of cap cDNA. In order to recover the intact 3' end of the cap transcript, the 3' primer is typically selected in the region of the polyadenylation signal. However, the invention is not so limited and other similar strategies can be employed to isolate novel cDNA sequences of this and other AAV genes.

In some cases, multiple primer sets are used to isolate novel cDNA sequences of an AAV gene in fragments. Fragments so obtained can, for example, be cloned together to form a single cDNA comprising a complete gene sequence. For example, a first primer set having a 5' primer complementary to an untranslated region of an AAV gene and a 3' primer (anchor primer) complementary to a sequence within the AAV transcript (e.g., in an intronic or exonic sequence) can be used to obtain a first fragment (e.g., a 5' fragment of a gene sequence). A second primer set, having a 5' primer (e.g., anchor primer) complementary to a sequence upstream of the second 3' primer of the first primer set and a 3' primer complementary to a position near the polyadenylation signal can be used to obtain a second fragment (e.g., a 3' fragment of a gene sequence). The two fragments can have any number of uses thereafter, for example they can be analyzed separately (e.g., sequenced) or cloned together to obtain a complete gene sequence. In some cases, three, four, five, six or more primer sets can be used to obtain three, four, five, six or more of AAV gene fragments. Moreover, these examples are not meant to be limiting and any number of primer sets can be employed to obtain any number of fragments provided that the fragments are useful for identifying and obtaining unique AAV sequences (e.g., Capsid gene sequences).

In some cases, the methods involve transfecting cells with total cellular DNAs isolated from the tissues that potentially harbor proviral AAV genomes at very low abundance and supplementing with helper virus function (e.g., adenovirus) to trigger and/or boost AAV rep and cap gene transcription in the transfected cell. In some cases, RNA from the transfected cells provides a template for RT-PCR amplification of cDNA and the detection of novel AAVs. In cases where cells are transfected with total cellular DNAs isolated from the tissues that potentially harbor proviral AAV genomes, it is often desirable to supplement the cells with factors that promote AAV gene transcription. For example, the cells may also be infected with a helper virus, such as an Adenovirus or a Herpes Virus. In a specific embodiment, the helper functions are provided by an adenovirus. The adenovirus may be a wild-type adenovirus, and may be of human or non-human origin, preferably non-human primate (NHP) origin. Similarly adenoviruses known to infect non-human animals (e.g., chimpanzees, mouse) may also be employed in the methods of the invention (See, e.g., U.S. Pat. No. 6,083,716). In addition to wild-type adenoviruses, recombinant viruses or non-viral vectors (e.g., plasmids, episomes, etc.) carrying the necessary helper functions may be utilized. Such recombinant viruses are known in the art and may be prepared according to published techniques. See, e.g., U.S. Pat. Nos. 5,871,982 6,251,677, which describe a hybrid Ad/AAV virus. A variety of adenovirus strains are available from the American Type Culture Collection, Manassas, Va., or available by request from a variety of commercial and institutional sources. Further, the sequences of many such strains are available from a variety of databases including, e.g., PubMed and GenBank.

Cells may also be transfected with a vector (e.g., helper vector) which provides helper functions to the AAV. The vector providing helper functions may provide adenovirus functions, including, e.g., E1a, E1b, E2a, E4ORF6. The sequences of adenovirus gene providing these functions may be obtained from any known adenovirus serotype, such as serotypes 2, 3, 4, 7, 12 and 40, and further including any of the presently identified human types known in the art. Thus, in some embodiments, the methods involve transfecting the cell with a vector expressing one or more genes necessary for AAV replication, AAV gene transcription, and/or AAV packaging.

In some cases, a novel isolated capsid gene can be used to construct and package recombinant AAV vectors, using methods well known in the art, to determine functional characteristics associated with the novel capsid protein encoded by the gene. For example, novel isolated capsid genes can be used to construct and package recombinant AAV (rAAV) vectors comprising a reporter gene (e.g., B-Galactosidase, GFP, Luciferase, etc.). The rAAV vector can then be delivered to an animal (e.g., mouse) and the tissue targeting properties of the novel isolated capsid gene can be determined by examining the expression of the reporter gene in various tissues (e.g., heart, liver, kidneys) of the animal. Other methods for characterizing the novel isolated capsid genes are disclosed herein and still others are well known in the art.

Kits are useful in some instances for practicing these methods in order to rescue contaminates by helper AAV infections and/or detection of latent virus that is transcriptionally active. Examples of such methods are shown in the Examples and in particular Example 4.

The containers of the kit may house, for instance, any one or more of the following: at least one RNA detection component, at least one primer that has substantial homology with a nucleic acid sequence that is about 90% conserved between at least two AAV serotypes, at least one primer that is substantially complementary to a nucleic acid sequence corresponding to a 5' or 3' untranslated region of an AAV transcript such as a transcript encoding a rep and/or cap gene, a set of PCR primers specific for a signature region of the AAV nucleic acid sequence, a set of PCR primers specific for the full-length AAV capsid transcript (i.e., the p40 initiated transcript), two or more additional sets of primers, as described herein, and/or PCR probes, a primer having a sequence as set forth in SEQ ID NO: 1, SEQ ID NO: 2, SEQ ID NO: 3 or SEQ ID NO: 4.

The kits may also include reagents for Reverse transcription components that may include the following components: (a) at least one primer; (b) a Reverse Transcriptase (e.g., a Superscript); (c) nucleotides (e.g., dNTPs); and (d) RT buffer. In some embodiments, the at least one primer is complementary to a portion of an AAV cDNA sequence. In some embodiments, the at least one primer is an OligodT primer. In some embodiments, the kits further comprise reagents for PCR components that may include the following components: (a) at least one primer; (b) a thermostable polymerase (e.g., a Taq polymerase); (c) nucleotides (e.g., dNTPs); and (d) PCR buffer. In some embodiments, the at least one primer is complementary to a portion of an AAV cDNA sequence. In some embodiments, the kits comprise a DNA isolation kit (e.g., Oragene, OG-100) and/or an RNA isolation kit (e.g., oligodT-cellulose columns).

The kit may have a variety of forms, such as a blister pouch, a shrink wrapped pouch, a vacuum sealable pouch, a sealable thermoformed tray, or a similar pouch or tray form, with the accessories loosely packed within the pouch, one or more tubes, containers, a box or a bag. The kit may be sterilized after the accessories are added, thereby allowing the individual accessories in the container to be otherwise unwrapped. The kits can be sterilized using any appropriate sterilization techniques, such as radiation sterilization, heat sterilization, or other sterilization methods known in the art. The kit may also include other components, depending on the specific application, for example, containers, cell media, salts, buffers, reagents, syringes, needles, a fabric, such as gauze, for applying or removing a disinfecting agent, disposable gloves, a support for the agents prior to administration etc.

The instructions included within the kit may involve methods for detecting a latent AAV in a cell. In addition, kits of the invention may include, instructions, a negative and/or positive control, containers, diluents and buffers for the sample, sample preparation tubes and a printed or electronic table of reference AAV sequence for sequence comparisons.

EXAMPLES

Example 1

Discovering New AAVs by Determining the Sequence of AAV Transcripts Expressed from the Proviral Genome in Cells The presence of Endogenous AAV transcripts in non-AAV transfer vector treated Macaque tissues was examined by RT-PCR. PCR primers directed against Rep and Cap sequences were used for RT-PCR. DNase treated RNA samples were used to control for amplification of contaminating genomic DNA having rep and cap sequences. No Reverse Transcription and No DNAse controls were included. Surprisingly, endogenous AAV transcripts are detected in tissues of multiple non-AAV transfer vector treated Macaques. The results indicate that endogenous proviral genomes of AAV are transcriptionally active.

A strategy was developed for designing primers useful for RT-PCR detection of AAV RNA and identification novel AAV gene sequences such as the capsid gene. Primers were selected in a highly conserved region between multiple AAV genomes corresponding to the 5' untranslated region of a gene. A primer was designed in a highly conserved region between multiple AAV genomes corresponding to the 5' untranslated region of the VP1 gene and a portion of the VP1 open reading frame. The primer, identified as primer.CapF (i.e., SEQ ID NO 1 or 3), is a forward primer for an AAV Cap gene.

Primers were selected in a highly conserved region between multiple AAV genomes corresponding to the 3' untranslated region of a gene. A primer was designed in a highly conserved region between multiple AAV genomes corresponding to the 3' untranslated region of the VP1, 2, and 3 gene and a portion of the VP1, 2, and 3 open reading frame. The primer, identified as primer.CapR (i.e., SEQ ID NO 2 or 4), is a reverse primer for an AAV Cap gene. The primer, identified as AV2cas, is a reverse primer for an AAV Cap gene.

Example 2

Isolation of Transcriptionally Active Novel AAV Capsid Sequences from Chimpanzee Tissues for Vector Development In an attempt to search for novel AAVs with propensities to infect primates, a variety of chimpanzee tissues were analyzed for the presence of AAV proviral genomes and cap RNAs first by qPCR and qRT-PCR using a set of primer and probe to target short stretches of the conserved cap sequence. The data indicated that all the tissues harbored AAV in variable abundances, with the highest copy numbers in liver. Also, cap gene was indeed transcriptionally active and cap RNAs were detected in all the samples, but levels of cap RNA were more consistent among different tissues with copy numbers, generally speaking, higher than DNA sequences. Subsequently, PCR and RT-PCR cloning were undertaken to rescue full length capsid sequences from both chimpanzee DNAs and RNAs. A total of 48 cDNA and 28 DNA clones of VP1 were analyzed by sequencing. The phylogenetic analysis segregated those clones into three major groups closely related to AAV1, AAV6 and AAV9 which hold promises for gene delivery to lung, CNS and skeletal and cardiac muscle targets, respectively, in murine, canine and NHP models. Further analysis of those clones led to several key findings. First, in any tissues where both cDNA and DNA clones were generated, the capsid sequences of DNA and cDNA origins are phylogenetically different. While all the clones of AAV1 relatives were derived from chimpanzee cellular DNAs, all of AAV6-like and a majority of AAV9-like clones were the products of RT-PCR. Secondly, full length cap RT-PCR did not recover products from chimp spleen and heart, although the copy numbers of the transcripts in those two tissues by qRT-PCR were similar to those of other tissues. Finally, only cap cDNA, not DNA, clones were isolated from brain and lung tissues. A subset of the novel AAV clones were selected on the basis of their sequence distinctiveness from their AAV1, AAV6 and AAV9 relatives for further evaluation of vector packaging, tissue tropism, gene transfer efficiency and stability, sero-prevalence, vector-related toxicity and pathology, capsid and transgene T cell, etc. Dendrograms depicting the results of hierarchical cluster analyses of the new AAVs are provided in FIGS. 5-9. Table 2 provides a listing of the BLAST results using the sequences of the isolated AAVs as query sequences. The accession numbers and AAV serotypes of the best match sequences are provided. Fractions of identical amino acids and gap sites are also provided. Table 3A provides the group number of each variant based on nucleic acid alignment, the name of each variant, the tissue from which each variant was isolated, an indication of whether a variant was isolated from genomic DNA (gDNA) or using RT-PCR (cDNA); the length of the DNA and translated protein sequences of each variant; and the corresponding SEQ ID NOs. DNA sequences of Csp-3, Csp-7, Ckd-B6, Ckb-B8, CLv-D6, CLv-D7, Clg-f1, Clg-f8, Csp-10, Csp-4, Ckd-4, CLv-12, Clv-3 contained mutation(s) that led to impaired VP1 protein translation. Those sequences were repaired manually before they could be translated into a complete VP1 protein sequences. A listing of the SEQ ID NOs of the non-repaired DNA sequences is provided in Table 3B. Table 3C lists additional AAV9 variants discovered in chimpanzee tissues. Table 3D lists AAV serotypes of Table 3A and their corresponding SEQ ID NOs. Table 4A-C provides a comparison of certain corresponding amino acids among example AAV variants and their related AAV serotypes.

TABLE 2

BLAST RESULTS USING - NOVEL AAV QUERY SEQUENCES

| | Best match found with blastp in GB | | | |
|---|---|---|---|---|
| query | accession | name | identity | gaps |
| CKd-B6 | AAB95450.1 | AAV6 | 729/736 | 0/736 |
| CKd-B1 | AAB95450.1 | AAV6 | 732/736 | 0/736 |
| CKd-B2 | AAB95450.1 | AAV6 | 733/736 | 0/736 |
| CBr-E6 | AAS99264.1 | AAV9 | 732/736 | 1/736 |
| CLv-D2 | AAS99264.1 | AAV9 | 731/736 | 0/736 |
| CLv-D8 | AAS99264.1 | AAV9 | 732/736 | 0/736 |
| CLv-R1 | AAS99264.1 | AAV9 | 732/736 | 0/736 |
| CLv-R7 | AAS99264.1 | AAV9 | 728/736 | 0/736 |
| CLg-F3 | AAS99264.1 | AAV9 | 731/736 | 0/736 |
| CLg-F4 | AAS99264.1 | AAV9 | 730/736 | 0/736 |
| CLg-F7 | AAS99264.1 | AAV9 | 732/736 | 0/736 |
| CSp-1 | AAS99264.1 | AAV9 | 732/736 | 0/736 |
| CSp-3 | AAS99264.1 | AAV9 | 730/736 | 0/736 |
| CSp-7 | AAS99264.1 | AAV9 | 732/736 | 0/736 |
| CBr-E1 = CLv-E1 | AAS99264.1 | AAV9 | 734/736 | 0/736 |
| CBr-E2 | AAS99264.1 | AAV9 | 734/736 | 0/736 |
| CBr-E3 | AAS99264.1 | AAV9 | 735/736 | 0/736 |
| CBr-E4 | AAS99264.1 | AAV9 | 735/736 | 0/736 |
| CBr-E5 | AAS99264.1 | AAV9 | 733/736 | 0/736 |
| CBr-e5 | AAS99264.1 | AAV9 | 734/736 | 0/736 |
| CBr-E7 | AAS99264.1 | AAV9 | 734/736 | 1/736 |
| CBr-E8 | AAS99264.1 | AAV9 | 734/736 | 0/736 |
| CLv-D1 | AAS99264.1 | AAV9 | 733/736 | 0/736 |
| CLv-D3 | AAS99264.1 | AAV9 | 734/736 | 0/736 |
| CLv-D4 | AAS99264.1 | AAV9 | 734/736 | 0/736 |
| CLv-D5 | AAS99264.1 | AAV9 | 734/736 | 0/736 |
| CLv-D6 | AAS99264.1 | AAV9 | 735/736 | 0/736 |
| CLv-D7 | AAS99264.1 | AAV9 | 732/736 | 0/736 |
| CLv-R2 | AAS99264.1 | AAV9 | 734/736 | 0/736 |
| CLv-R3 | AAS99264.1 | AAV9 | 735/736 | 0/736 |
| CLv-R4 | AAS99264.1 | AAV9 | 734/736 | 0/736 |
| CLv-R5 | AAS99264.1 | AAV9 | 733/736 | 0/736 |
| CLv-R6 | AAS99264.1 | AAV9 | 736/736 | 0/736 |
| CLv-R8 | AAS99264.1 | AAV9 | 735/736 | 0/736 |
| CLv-R9 | AAS99264.1 | AAV9 | 730/736 | 0/736 |
| CLg-F1 | AAS99264.1 | AAV9 | 730/736 | 0/736 |
| CLG-F2 | AAS99264.1 | AAV9 | 732/736 | 0/736 |
| CLg-F5 = CLg-F6 = CLg-F8 | AAS99264.1 | AAV9 | 734/736 | 0/736 |
| CSp-10 | AAS99264.1 | AAV9 | 735/736 | 0/736 |
| CSp-11 | AAS99264.1 | AAV9 | 733/736 | 0/736 |
| CSp-2 | AAS99264.1 | AAV9 | 733/736 | 0/736 |
| CSp-4 | AAS99264.1 | AAV9 | 733/736 | 0/736 |
| CSp-6 | AAS99264.1 | AAV9 | 733/736 | 0/736 |
| CSp-8 | AAS99264.1 | AAV9 | 735/736 | 0/736 |
| CSp-9 | AAS99264.1 | AAV9 | 734/736 | 0/736 |
| CKd-H2 | ABA71701.1 | AAV.VR-355(AAV6 like) | 727/732 | 0/732 |
| CKd-B3 | ACB55301.1 | AAV6.1 | 729/736 | 0/736 |
| CKd-B8 | ACB55301.1 | AAV6.1 | 732/736 | 0/736 |
| CKd-B4 | ACB55301.1 | AAV6.1 | 731/736 | 0/736 |
| CKd-B5 = CKd-H6 | ACB55301.1 | AAV6.1 | 734/736 | 0/736 |
| CKd-B7 | ACB55301.1 | AAV6.1 | 730/736 | 0/736 |
| CKd-H1 | ACB55301.1 | AAV6.1 | 732/736 | 0/736 |
| CKd-H3 | ACB55301.1 | AAV6.1 | 733/736 | 0/736 |
| CKd-H4 | ACB55301.1 | AAV6.1 | 732/736 | 0/736 |
| CKd-H5 | ACB55301.1 | AAV6.1 | 731/736 | 0/736 |
| CKd-3 | ACB55310.1 | AAV.hu.48R3 | 735/736 | 0/736 |
| CKd-1 | NP_049542.1 | AAV1 | 733/736 | 0/736 |
| CKd-7 | NP_049542.1 | AAV1 | 731/736 | 0/736 |
| CLv-4 | NP_049542.1 | AAV1 | 733/736 | 0/736 |
| CHt-2 | NP_049542.1 | AAV1 | 734/736 | 0/736 |
| CHt-3 | NP_049542.1 | AAV1 | 735/736 | 0/736 |
| Ckd-10 | NP_049542.1 | AAV1 | 734/736 | 0/736 |
| CKd-2 | NP_049542.1 | AAV1 | 734/736 | 0/736 |
| CKd-4 | NP_049542.1 | AAV1 | 733/736 | 0/736 |
| CKd-6 | NP_049542.1 | AAV1 | 733/736 | 0/736 |
| CKd-8 | NP_049542.1 | AAV1 | 734/736 | 0/736 |
| CLv-1 | NP_049542.1 | AAV1 | 734/736 | 0/736 |
| CLv-12 | NP_049542.1 | AAV1 | 733/736 | 0/736 |
| CLv-13 | NP_049542.1 | AAV1 | 734/736 | 0/736 |
| CLv-2 | NP_049542.1 | AAV1 | 734/736 | 0/736 |
| CLv-3 | NP_049542.1 | AAV1 | 730/736 | 0/736 |
| CLv-6 | NP_049542.1 | AAV1 | 734/736 | 0/736 |
| CLv-8 | NP_049542.1 | AAV1 | 735/736 | 0/736 |
| CHt-1 | YP_680426.1 | AAV2 | 734/735 | 0/735 |

Total proteins 78
Non-redundant 74
CBr-E1 = CLv-E1
CLg-F5 = CLg-F6 = CLg-F8
CKd-B5 = CKd-H6
Table 3A outlines the properties of isolated AAVs and provides SEQ ID NOS for each AAV
Table 3B lists examples of unedited DNA sequences
Table 3C provides the protein sequences of additional isolated AAV9 variants.

TABLE 3A

SEQUENCES OF NOVEL AAVS

| Group (based on DNA alignment) | Name | Tissue | gDNA or cDNA | DNA length (bp) | DNA SEQ ID NO: | Protein length (aa, amino acid)- Predicted | PROTEIN SEQ ID NO: |
|---|---|---|---|---|---|---|---|
| 1 | CBr-E1 | Brain | cDNA | 2208 | 13 | 736 | 87 |
| 1 | CBr-E2 | Brain | cDNA | 2208 | 14 | 736 | 88 |
| 1 | CBr-E3 | Brain | cDNA | 2208 | 15 | 736 | 89 |
| 1 | CBr-E4 | Brain | cDNA | 2208 | 16 | 736 | 90 |
| 1 | CBr-E5 | Brain | cDNA | 2208 | 17 | 736 | 91 |
| 1 | CBr-e5 | Brain | cDNA | 2208 | 18 | 736 | 92 |
| 1 | CBr-E6 | Brain | cDNA | 2205 | 19 | 735 | 93 |
| 1 | CBr-E7 | Brain | cDNA | 2205 | 20 | 735 | 94 |

TABLE 3A-continued

SEQUENCES OF NOVEL AAVS

| Group (based on DNA alignment) | Name | Tissue | gDNA or cDNA | DNA length (bp) | DNA SEQ ID NO: | Protein length (aa, amino acid)- Predicted | PROTEIN SEQ ID NO: |
|---|---|---|---|---|---|---|---|
| 1 | CBr-E8 | Brain | cDNA | 2208 | 21 | 736 | 95 |
| 1 | CLv-D1 | Liver | cDNA | 2208 | 22 | 736 | 96 |
| 1 | CLv-D2 | Liver | cDNA | 2208 | 23 | 736 | 97 |
| 1 | CLv-D3 | Liver | cDNA | 2208 | 24 | 736 | 98 |
| 1 | CLv-D4 | Liver | cDNA | 2208 | 25 | 736 | 99 |
| 1 | CLv-D5 | Liver | cDNA | 2208 | 26 | 736 | 100 |
| 1 | CLv-D6 | Liver | cDNA | 2209 | 27 | 736 | 101 |
| 1 | CLv-D7 | Liver | cDNA | 2208 | 28 | 736 | 102 |
| 1 | CLv-D8 | Liver | cDNA | 2208 | 29 | 736 | 103 |
| 1 | CLv-E1 | Liver | cDNA | 2208 | 13 | 736 | 87 |
| 1 | CLv-R1 | Liver | cDNA | 2208 | 30 | 736 | 104 |
| 1 | CLv-R2 | Liver | cDNA | 2208 | 31 | 736 | 105 |
| 1 | CLv-R3 | Liver | cDNA | 2208 | 32 | 736 | 106 |
| 1 | CLv-R4 | Liver | cDNA | 2208 | 33 | 736 | 107 |
| 1 | CLv-R5 | Liver | cDNA | 2208 | 34 | 736 | 108 |
| 1 | CLv-R6 | Liver | cDNA | 2208 | 35 | 736 | 109 |
| 1 | CLv-R7 | Liver | cDNA | 2208 | 36 | 736 | 110 |
| 1 | CLv-R8 | Liver | cDNA | 2208 | 37 | 736 | 111 |
| 1 | CLv-R9 | Liver | cDNA | 2208 | 38 | 736 | 112 |
| 1 | CLg-F1 | Lung | cDNA | 2207 | 39 | 735 | 113 |
| 1 | CLg-F2 | Lung | cDNA | 2208 | 40 | 736 | 114 |
| 1 | CLg-F3 | Lung | cDNA | 2208 | 41 | 736 | 115 |
| 1 | CLg-F4 | Lung | cDNA | 2208 | 42 | 736 | 116 |
| 1 | CLg-F5 | Lung | cDNA | 2208 | 43 | 736 | 117 |
| 1 | CLg-F6 | Lung | cDNA | 2208 | 43 | 736 | 117 |
| 1 | CLg-F7 | Lung | cDNA | 2208 | 44 | 736 | 118 |
| 1 | CLg-F8 | Lung | cDNA | 2208 | 43 | 736 | 117 |
| 1 | CSp-1 | Spleen | gDNA | 2208 | 45 | 736 | 119 |
| 1 | CSp-10 | Spleen | gDNA | 2207 | 46 | 735 | 120 |
| 1 | CSp-11 | Spleen | gDNA | 2208 | 47 | 736 | 121 |
| 1 | CSp-2 | Spleen | gDNA | 2208 | 48 | 736 | 122 |
| 1 | CSp-3 | Spleen | gDNA | 2207 | 49 | 735 | 123 |
| 1 | CSp-4 | Spleen | gDNA | 2208 | 50 | 736 | 124 |
| 1 | CSp-6 | Spleen | gDNA | 2208 | 51 | 736 | 125 |
| 1 | CSp-7 | Spleen | gDNA | 2208 | 52 | 736 | 126 |
| 1 | CSp-8 | Spleen | gDNA | 2208 | 53 | 736 | 127 |
| 1 | CSp-9 | Spleen | gDNA | 2208 | 54 | 736 | 128 |
| 2 | CHt-2 | Heart | gDNA | 2208 | 55 | 736 | 129 |
| 2 | CHt-3 | Heart | gDNA | 2208 | 56 | 736 | 130 |
| 2 | CKd-1 | Kidney | gDNA | 2208 | 57 | 736 | 131 |
| 2 | Ckd-10 | Kidney | gDNA | 2208 | 58 | 736 | 132 |
| 2 | CKd-2 | Kidney | gDNA | 2208 | 59 | 736 | 133 |
| 2 | CKd-3 | Kidney | gDNA | 2208 | 60 | 736 | 134 |
| 2 | CKd-4 | Kidney | gDNA | 2208 | 61 | 736 | 135 |
| 2 | CKd-6 | Kidney | gDNA | 2208 | 62 | 736 | 136 |
| 2 | CKd-7 | Kidney | gDNA | 2208 | 63 | 736 | 137 |
| 2 | CKd-8 | Kidney | gDNA | 2208 | 64 | 736 | 138 |
| 2 | CLv-1 | Liver | gDNA | 2208 | 65 | 736 | 139 |
| 2 | CLv-12 | Liver | gDNA | 2208 | 66 | 736 | 140 |
| 2 | CLv-13 | Liver | gDNA | 2208 | 67 | 736 | 141 |
| 2 | CLv-2 | Liver | gDNA | 2208 | 68 | 736 | 142 |
| 2 | CLv-3 | Liver | gDNA | 2207 | 69 | 735 | 143 |
| 2 | CLv-4 | Liver | gDNA | 2208 | 70 | 736 | 144 |
| 2 | CLv-6 | Liver | gDNA | 2208 | 71 | 736 | 145 |
| 2 | CLv-8 | Liver | gDNA | 2208 | 72 | 736 | 146 |
| 3 | CKd-B1 | Kidney | cDNA | 2208 | 73 | 736 | 147 |
| 3 | CKd-B2 | Kidney | cDNA | 2208 | 74 | 736 | 148 |
| 3 | CKd-B3 | Kidney | cDNA | 2208 | 75 | 736 | 149 |
| 3 | CKd-B4 | Kidney | cDNA | 2208 | 76 | 736 | 150 |
| 3 | CKd-B5 | Kidney | cDNA | 2208 | 77 | 736 | 151 |
| 3 | CKd-B6 | Kidney | cDNA | 2208 | 78 | 736 | 152 |
| 3 | CKd-B7 | Kidney | cDNA | 2208 | 79 | 736 | 153 |
| 3 | CKd-B8 | Kidney | cDNA | 2211 | 80 | 736 | 154 |
| 3 | CKd-H1 | Kidney | cDNA | 2208 | 81 | 736 | 155 |
| 3 | CKd-H2 | Kidney | cDNA | 2196 | 82 | 732 | 156 |
| 3 | CKd-H3 | Kidney | cDNA | 2208 | 83 | 736 | 157 |
| 3 | CKd-H4 | Kidney | cDNA | 2208 | 84 | 736 | 158 |
| 3 | CKd-H5 | Kidney | cDNA | 2208 | 85 | 736 | 159 |
| 3 | CKd-H6 | Kidney | cDNA | 2208 | 77 | 736 | 151 |
| 4 | CHt-1 | Heart | gDNA | 2205 | 86 | 735 | 160 |

TABLE 3B

EXAMPLE UNEDITED SEQUENCES OF ISOLATED AAVS

| Group (based on DNA alignment) | Name | Tissue | gDNA or cDNA | DNA SEQ ID NO: |
|---|---|---|---|---|
| 1 | CLv-D6 | Liver | cDNA | 161 |
| 1 | CLg-F1 | Lung | cDNA | 162 |
| 1 | CLg-F8 | Lung | cDNA | 163 |
| 1 | CSp-10 | Spleen | gDNA | 164 |
| 1 | CSp-3 | Spleen | gDNA | 165 |
| 1 | CSp-4 | Spleen | gDNA | 166 |
| 2 | CKd-4 | Kidney | gDNA | 167 |
| 2 | CLv-12 | Liver | gDNA | 168 |
| 2 | CLv-3 | Liver | gDNA | 169 |
| 3 | CKd-B8 | Kidney | cDNA | 170 |

TABLE 3C

Additional AAV9 Variants

| Name (a.a. length) | SEQ ID NO: |
|---|---|
| CLv1-1 (736) | 171 |
| CLv1-2 (736) | 172 |
| CLv1-3 (736) | 173 |
| CLv1-4 (736) | 174 |
| CLv1-7 (736) | 175 |
| CLv1-8 (736) | 176 |
| CLv1-9 (736) | 177 |
| CLv1-10 (736) | 178 |

TABLE 3D

AAV CAPSID SEQUENCES

| Name | GenBank Accession Number | SEQ ID NO | SEQ ID NO's of VARIANTS |
|---|---|---|---|
| AAV6 | AAB95450.1 | 179 | 147, 148, 152 |
| AAV9 | AAS99264.1 | 180 | 87-128 |
| AAV.VR-355 (AAV6 like) | ABA71701.1 | 181 | 156 |
| AAV6.1 | ACB55301.1 | 182 | 149-151, 153-155, 157-159 |
| AAV.hu.48R3 | ACB55310.1 | 183 | 134 |
| AAV1 | NP_049542.1 | 184 | 129-133 or 135-146 |
| AAV2 | YP_680426.1 | 185 | 160 |

TABLE 4A

Amino Acid Differences of Example AAV9 Variants

| Amino Acid Position | AAV9 (SEQ ID NO 178) | Csp3 (SEQ ID NO: 123) | CLv-D8 (SEQ ID NO 103) | Clg-F1 (SEQ ID NO: 113) |
|---|---|---|---|---|
| 74 | E | E | E | V |
| 93 | Y | Y | Y | C |
| 203 | M | I | M | M |
| 259 | Q | R | Q | Q |
| 275 | F | F | F | L |
| 321 | Q | R | Q | Q |
| 335 | A | T | A | A |
| 373 | M | M | M | T |
| 445 | Y | Y | H | Y |
| 495 | Q | R | Q | Q |
| 527 | H | H | Y | H |
| 533 | R | R | S | R |
| 639 | M | V | M | M |
| 647 | I | I | T | I |
| 729 | T | T | T | P |
| 736 | L | L | L | F |

TABLE 4B

Amino Acid Differences of an Example AAV1 Variant

| Amino Acid Position | AAV1 (SEQ ID NO: 182) | CkD-7 (SEQ ID NO: 137) |
|---|---|---|
| 38 | K | E |
| 599 | M | T |
| 601 | A | T |
| 651 | N | T |
| 717 | N | D |

TABLE 4C

Amino Acid Differences of Example AAV6.1 Variants

| Amino Acid Position | AAV6.1 (SEQ ID NO: 180) | Ckd-B7 (SEQ ID NO: 153) | Ckd-B8 (SEQ ID NO: 154) |
|---|---|---|---|
| 7 | L | F | L |
| 161 | K | R | K |
| 260 | I | I | T |
| 418 | D | E | E |
| 496 | N | N | Y |
| 584 | L | F | F |
| 589 | T | P | T |
| 722 | T | S | T |

Example 3

Isolation and Characterization of Novel Cap cDNAs from the Primate Brain and Other Tissues that are Naturally Infected with AAV9 Variants Naturally occurring AAV9 variants that are capable of escaping from host immune defenses and are transcriptionally active, serve as good substrates for retrieval of novel cap cDNA. Recent results revealed the presence of both rep and cap gene transcripts in rhesus and cynomolgus macaque tissues. Results disclosed herein corroborate these findings in chimpanzee tissues and provide a panel of novel AAV capsid cDNA clones that group with AAV9 clade phylogenetically. Brain and other tissues from chimpanzees were analyzed for cap RNA transcripts, and cap cDNA clones were isolated and analyzed by RT-PCR cloning for sequence characterization. The cap cDNA clones with 4 or more amino acid differences from AAV9 and within themselves were selected for further characterization, based on their phylogenetic grouping and vector productivity. (See Tables 3A-C).

Transcriptional activity of rep/cap genes in the AAV DNA positive NHP tissues was evaluated by RT-PCR analysis. The presence of rep/cap transcripts in some NHP tissues was confirmed. Next, cap cDNAs from NHP tissues were isolated for vector development purposes, aiming to identify novel capsid sequences that are phylogenetically close to AAV9, similar or better in crossing the BBB via intravascular delivery but, importantly, more immunologically suitable for stable and efficient gene transfer. To this end, considering phylogenetic and physiological closeness of chimpanzees to humans as well as recent work in which the chimp was found to be a better model in some instances to predict performance of AAV vectors in human airway epithelial cells, 6 tissues (brain, heart, kidney, liver, lung and spleen) were evaluated from two chimps for AAV cap sequences. The data indicated that all the tissues harbored AAV in variable abundances, with the highest copy numbers in the liver. Also, cap gene was indeed transcriptionally active and cap RNAs were detected in all the samples. The levels of cap RNAs were consistent among different tissues with the copy numbers higher than DNA sequences.

Subsequently, PCR and RT-PCR cloning was undertaken to rescue full length capsid sequences from both chimpanzee DNAs and RNAs respectively. A total of 48 cDNA and 28 DNA clones of VP1 were isolated by RT-PCR and PCR and fully sequenced. The phylogenetic analysis segregated those clones into three major groups that are closely related to AAV1, AAV6 and AAV9, which hold promises for gene delivery to lung, skeletal and cardiac muscle, and CNS targets, respectively. Interestingly, 45 out of these 76 clones were AAV9-like, of which 35 clones were the products of RT-PCR. A subset of the novel AAV9-like clones were selected for further evaluation on the basis of their sequence predicted structural distinctiveness from AAV9. The selected clones are comprised of 12 cDNA clones and 3 DNA clones with 4-6 amino acid differences from the cap sequence of AAV9. Thus, feasibility of isolating cap cDNAs of novel AAV9 variants from the transcriptionally active AAV genomes resided in NHP tissues was demonstrated.

Using a web-based protein structure homology modeling program, the Swiss-Model, AAV9 VP3 structure was predicted using the published AAV8 crystal structure as the reference, where the regions with biggest differences between AAV8 and AAV9 were identified. (Arnold K, Bordoli L, Kopp J, Schwede T. The SWISS-MODEL workspace: a web-based environment for protein structure homology modelling. Bioinformatics 2006; 22:195-201.). Each of those 15 capsid sequences of AAV9 variants were compared with that of AAV9 and identified a total of 54 amino acid changes in which 37 changes are located in the predicted AAV9 VP3 crystal structure. Interestingly, some of those changes are found in the T cell epitopes and proposed receptor binding domains identified previously, suggesting potential differences in the vector biology including T cell immunological profiles (3, 17, 18).

Example 4

Characterization of Isolated AAVs

More than 50 full length capsid sequences that are closely related to AAV9 were isolated from chimpanzee tissues. A subset of these novel AAV9 variants that were retrieved from either cellular DNA by PCR (Csp3 and Csp7) or RNA by RT-PCR (ClgF1, ClgF4, ClvD8, ClvR7 and ClvR9) were selected for vector development and evaluation. Relationships between capsid structure and vector biology, and production yield were investigated; a summary of this characterization is provided as Table 5. The vectors were evaluated in C57BL/6 mice for nLacZ gene transduction of liver, heart, pancreas, skeletal, muscle and lung (FIG. 12-13). Differences in capsid sequences between AAV9 and these seven novel variants range from 4 to 6 amino acids. Three vectors were packaged efficiently whereas the other four were not, suggesting that several amino acids are critical for AAV9 packaging. Those three vectors were evaluated in C57BL/6 mice for nLacZ and α1-anti-trypsin (A1AT) gene transduction after intravenous (i.v.), intramuscular (i.m.), and intra-nasal (i.n.) administration (FIG. 14).

A study comparing nLacZ transduction in liver, skeletal muscle and lung was performed. The results of this study suggested that Csp3 outperforms AAV9. In the lung, both Csp3 and ClvD8 primarily target alveoli as does AAV9 (FIG. 15.) However, data from quantitative comparisons at early time points using A1AT as a reporter gene demonstrated no significant differences in liver and muscle transduction between AAV9 and Csp3. A slight increase by Csp3 compared with AAV9 was observed in A1AT transduction in lung after intranasal delivery. Additionally, while ClgF1 vector lead to poor expression of both transgenes (nLacz and A1AT) in all target tissues, the ClvD8 effectively transduces muscle and lung.

Using newly established crystal structure of AAV9 VP3 as the model, the capsid structure of Csp3, which differs from AAV9 in 6 amino acid residues, with that of AAV9. Of these six amino acids, the methionine at amino acid position 203 is conserved, and although not present in the crystal structure, should be located inside near the 5 fold pore and may play a role in AAV transduction. The glutamine at amino acid position 259 is located at the subunit interface of monomers that form pentamers. The glutamine at amino acid position 321, which is near the base of 5-fold pore, is in a highly conserved region of the capsid, as is the alanine at amino acid position 335, which are inside the 5-fold channel. The glutamine at amino acid position 495 and the methionine at amino acid position 640 are located on the surface of 3-fold symmetry axis.

TABLE 5

Yield and Transduction Characterization of AAV Variants

| Name of variant | Amino acid difference from AAV9 | Productivity (×10e13 GC/ml) | | | nLacZ transduction | | | | A1AT expression (% AAV9) (4 w) (ng/ml) | | |
|---|---|---|---|---|---|---|---|---|---|---|---|
| | | nLacZ | EGFP | A1AT | Liver | Heart | Muscle | Lung | i.v. | i.m. | i.n. |
| AAV9 | 0 | 2 | 2 | 0.8 | ++++ | +++++ | ++++ | +++ | 100 (1.28E+08) | 100 (8.61E+06) | 100 (2.12E+03) |
| Csp-3 | 6 | 1 | 0.7 | 0.8 | +++++ | +++++ | +++++ | ++++ | 16.2 | 26.3 | 61.8 |
| Csp-7 | 4 | 0.06 | ND | ND | + | +/− | ND | ND | ND | ND | ND |
| Clg-F1 | 6 | 0.6 | 1 | 0.5 | + | +/− | + | + | 0.0002 | 0.008 | 14.5 |
| Clg-F4 | 6 | 0.028 | ND | ND | + | +/− | ND | ND | ND | ND | ND |
| Clv-D8 | 4 | 0.27 | 0.7 | 0.5 | + | +/− | ++ | +++ | 2.8 | 0.2 | 26.6 |
| Clv-R7 | 8 | NP | ND | ND | ND | ND | ND | ND | ND | ND | ND |
| Clv-R9 | 6 | NP | ND | ND | ND | ND | ND | ND | ND | ND | ND |
| Clv-1.9 | 4 | ND | ND | 0.4 | ND | ND | ND | ND | 0.1 | 0.2 | 34.4 |
| Clv-1.10 | 4 | ND | ND | 0.45 | ND | ND | ND | ND | 0.03 | 0.4 | 31.4 |

Example 5

Vector Creation and Screening for Vector Productivity Isolated AAV9 Variants The Blood-Brain-Barrier (BBB) is an important cellular and metabolic structure in the central nervous system (CNS). For the treatment of many CNS disorders, this important structure becomes a barricade that prevents the therapeutics from entering the CNS. Recombinant adeno-associated virus (rAAV) mediated gene transfer is an attractive strategy for treating CNS diseases. However, development of the rAAV based effective CNS gene therapeutics has been hindered by the deficiency of the earlier generations of vectors in crossing the BBB and globally delivering the genes to the CNS.

AAV vectors are created from novel AAV9 variants that have already been isolated and tested for packaging efficiency. Cap cDNAs are isolated of AAV9 variants from other primate tissues including macaques and humans through optimization of primer design and PCR conditions. The new cap cDNA clones are sequenced and more clones are selected that fall into AAV9 clades phylogenetically but have some structurally uniqueness for testing vector production. Considering high doses of vector are often required for intravascular delivered gene therapeutics to target the CNS vector production is often an important aspect of clinical vector development. Thus, vector titer and yield are among the criteria used for candidate selection. An objective is to identify novel AAV9 variants for large scale vector production and vector biology evaluation.

Another consideration in the vector creation and biological evaluation in vivo is the genome format of the reporter gene vector. Capsid structure plays a role in both cellular uptake and intracellular trafficking that lead to transduction. But the conversion of the transcriptionally inactive single stranded genomes to the double-stranded form depicts a remarkable post entry block (19). As a component of the analysis of vector biology on the capsid, the EGFP expressing self-complementary vector genome is used to produce vectors, which bypasses the genome conversion process and initiate transduction immediately after entering the nuclei of the target cells.

Since the capsid is a determinant of the AAV vector biology, a trans-encapsulation method is employed to package rAAV2 genomes with the capsids from naturally occurring AAV9 variants that are isolated. Briefly, chimeric packaging constructs are created by ligating the AAV2 Rep gene with Cap genes of novel AAVs at an Xho I site through a partial digestion. The first Xho I site in the AAV2 genome is located just at the very beginning of the VP1 gene where high homology among all known AAV sequences is observed. This Xho I site is present in AAV sequences which have been analyzed and has been used for constructing hybrid packaging plasmids of more than 50 novel AAVs, as previously reported (8).

As the first step of lead vector selection, hybrid packaging plasmids are assessed for their vector packaging efficiency in small scale test production. AAV cis plasmids carrying the self-complementary AAVEGFP (scAAVEGFP) genome are transfected into 293 cells in 6 well plates together with the chimeric packaging plasmids containing novel AAV capsid gene and adenovirus helper plasmid. AAV9 packaging plasmid is used as a control. Seventy-two hours later, crude cell lysate is harvested and subjected to 3 cycles of freezing and thawing. Serially diluted crude cell lysates are put on 293 cells in a 24 well plate in the presence of adenovirus helper. Numbers of EGFP positive cells resulting from new chimeric packaging plasmids are estimated and compared with that of AAV9.

A further criterion for candidate vector selection is that packaging plasmids should have scAAVEGFP productivity (as measured by 293 cell transduction) typically at a level no less than 10% of that produced by using AAV9 packaging plasmid for the large scale AAV vector production. The vectors are produced by the same protocol as used for the test production and are purified by standard $CsCl_2$ sedimentation method. Genome titers of purified vector preps are determined by real time PCR. The purity of the vector preps is examined by sliver stained SDS-PAGE and negative stained Electron Microscopy.

Isolation of More AAV9 Variants from Other Primate Tissue Sources for Vector Creation As indicated herein, available clones of cap cDNA from novel AAV9 variants are available from chimpanzee tissues. This collection of cap cDNAs of AAV9 relatives is expanded by isolating cap cDNAs in other primate tissues, particularly brain tissues. Without wishing to be bound by theory, brain tissue derived endogenous AAVs may have crossed the Blood-Brain Barrier (BBB) and established latency in the brain during natural infections. Endogenous AAVs that are transcriptionally active in human tissues may have the immunological properties more suitable for the human applications. In previously reported studies on novel AAV discovery, approximately 474 macaque tissues and 259 human tissues were collected with IRB approval (7). The same collection of frozen tissues is used for RNA extraction and recovery of cap cDNAs.

In this regard, primer design and RT-PCR conditions are optimized to enrich recovery of the cap cDNAs that fall into the AAV9 clade. In the initial isolation of novel cap cDNAs from chimpanzee tissues, universal primers were designed that could anneal to the 5' and 3' conservative regions of the cap genes of all available AAV sequences, aiming to amplify as many types of AAV sequences as possible. Depending on specific AAV sequences, sequence homology between the universal primers and a particular AAV sequence may vary. This may be compensated by using less stringent PCR conditions such as annealing temperatures, annealing/extension time and numbers of amplification cycles. This design strategy is effective to retrieve cap cDNA of all different AAVs but may not be sufficient to target and rescue the sequences that are closer to AAV9, in all cases. Using routine methods, primers are designed that have better matches with AAV9. The new primers are tested for the detection sensitivity and amplification efficiency under different RT-PCR conditions, using different RT-PCR reagents and the serially diluted AAV9 clone as the template. Different parameters that are evaluated include one-step RT-PCR versus two-step RT-PCR, oligo-dT versus random priming for cDNA creation, different reverse transcriptases, Taq polymerases and associated reagents, etc.

A next step in isolating the full length cap cDNA clones is the preparation of high quality of cellular RNAs with minimum cellular DNA contamination. This is accomplished by TRIzol-based tissue RNA extraction followed by the treatment with RNase-free DNase and purification using a column from the Qiagen RNeasy kit. This method removed cellular DNA contamination effectively as demonstrated by the lack of cap PCR band in the corresponding RT (−) reaction for each RT (+) PCR reaction. Leftover frozen primate tissues which were positive for endogenous AAV by cap PCR screening previously (19% of 474 NHP tissues and 18% of 259 human tissues) (7) are subjected to cellular RNA extraction and RT-PCR screening using the reagents and conditions optimized according to the methods disclosed herein. The RT-PCR products are cloned (e.g., TOPO-cloned) for sequencing characterization.

The sequences of new cap cDNA clones are compared with all available AAV sequences in the GenBank. Clones that fall into the AAV9 clade phylogenetically are chosen for redundancy assessment. The AAV9 variants from the same tissue and/or subject with less than 4 cap residue differences are considered as redundant (8). Newly isolated non-redundant clones of AAV9 variants are converted into chimeric packaging plasmids and first screened for AAV vector production as described above. A goal is to select variants that meet the acceptable productivity standards for the vector biology evaluation in vitro and in vivo.

Variations may occur in the yields of transcapsulated reporter gene vectors with different capsid variants in terms of total vector genome copies (GCs) as well as transduction titers when measured in vitro. AAV vector development has suggested a lack of correlation between in vitro and in vivo transduction. AAV9 vectors are produced routinely of different transgenes at yields in the ranges of $0.5\text{-}1\times10^5$ vector genomes per cell. Novel vectors with the yields less than $1\times10^4$ GCs/cell are not typically pursued. It is possible that the deficiency in vector packaging and transduction of some vectors could be caused by the incompatibilities between vector ITRs, rep, cap sequences and the origin of adenovirus helper genes. An alternative strategy is to rescue the infectious molecular clones of the endogenous AAV genomes from the original tissues and develop vectors in which ITRs, rep and cap sequences are derived from the same virus isolate (8). For the chimpanzee tissue derived AAV9 variants, helper genes from chimpanzee adenoviruses may be required for efficient vector packaging. In this case, molecular clones of chimpanzee adenoviruses may be modified for their application in the AAV vector production (20).

Selection of Lead Candidate Vectors (LCVs) and Clinical Candidate Vectors (CCVs) in Murine and Chimp Models A family of novel AAVs exists in NHPs and humans with structural and functional similarity to AAV9 clade and unique immunological properties that are candidates for global delivery of gene therapeutics to CNS intravascularly.

In addition to its superb transvascular gene transfer efficiency in heart and muscle, AAV9-based vector has demonstrated a unique capability to cross the BBB and lead to neuronal and neuroglial gene transfer in neonatal mice and astrocyte gene transfer in adult mice (9). CCVs are sought to be identified from candidates clones of AAV9 variants that have improved the immunological properties with respect to serological prevalence, capsid and transgene directed T cell immunity. Using AAV9 vector as the bench marker, LCVs are selected from starting clones of the novel AAV9 variants in vitro and in C57BL/6 mice for their capability to escape from serological barriers in pooled human IGIVs and to cross the BBB to achieve global CNS gene transfer. The LCVs with AAV9 are further compared in two strains of mice (C57BL/6 and BALB/c) for the cell type tropism, transduction efficiency and stability, dose response, vectortoxicity, and non-CNS tissue targeting. Gene transfer to a surrogate tissue of the chimpanzees, vector toxicity and transgene/capsid immunities in chimps is also tested.

Experimental Design

To identify CCVs from candidate vectors based on their biological merits, an algorithm is designed to enable CCVs selection in a data driven and quantitative manner. In this design, a total of 15 different parameters capturing all relevant aspects of the vector biology are evaluated at different stages of screening using a quantitative scoring system as summarized in Table 6. A score of 0, 1, 2, or 3 is used to assess each parameter. The specific scores based on the grading criteria are also presented in Table 6. The lower number represents the more favorable vector biology. In some cases, these 15 parameters are distilled down to the following 5 criteria: Preexisting immunity (in vitro and in vivo neutralization antibody (NAB)), gene transfer (efficiency, cell type tropism and stability), non-CNS tissue targeting (liver, heart and pancreas gene expression and vector genome biodistribution), toxicity [Liver function tests (LFTs), brain and liver histopathologies] and immunology (capsid and transgene T cells and vector capsid antibody). The rationale for combining some of the parameters into specific criteria such as LFTs and histopathology into "toxicity" are: 1.) they represent the same biology measured different ways, and 2.) provides equal weight in the final analysis for the basic 5 criteria.

TABLE 6

Algorithms for Selection of LCVs and CCVs

| Objective | Parameter | Measurement | Rating 0 | 1 | 2 | 3 |
|---|---|---|---|---|---|---|
| I. Selection of 3 LCVs from 15 candidate vectors | | | | | | |
| 1). Pre-existing Immunity/HIVIG | | | | | | |
| | In vitro/NAB titer | AAVx/AAV9 | <1x | =1x | 2-4x | >10x |
| | Passive transfer | hIGIV dose (mg)-inhibition | ≥40 | ≥12 | ≥4 | ≥1.2 |
| 2). CNS gene transfer in C57BL/6 mice by the clones passing serological tests 1 litter of neonates and 6 male adults per vector | | | | | | |
| | Spinal cord-total EGFP+ | AAVx/AAV9 | >1 | 0.5-1 | 0.25-0.5 | <0.1 |
| | Brain-total EGFP+ | AAVx/AAV9 | >1 | 0.5-1 | 0.25-0.5 | <0.1 |
| II. Selection of 2 CCVs from3 LCVs and AAV9 in C57BL/6 and BALB/c mice 3 Doses, 2 time points, 1 litter of neonates and 6 adults/vector/dose/time point | | | | | | |
| 1). Gene transfer | | | | | | |
| | Spinal cord % EGFP(+)/ ChAT(+) | AAVx/AAV9 | >1 | 0.5-1 | 0.25-0.5 | <0.1 |

TABLE 6-continued

Algorithms for Selection of LCVs and CCVs

| Objective | Parameter | Measurement | Rating 0 | 1 | 2 | 3 |
|---|---|---|---|---|---|---|
| | % EGFP(+)/GAFP(+) Brain | AAVx/AAV9 | >1 | 0.5-1 | 0.25-0.5 | <0.1 |
| | % EGFP(+)/NeuN(+) | AAVx/AAV9 | >1 | 0.5-1 | 0.25-0.5 | <0.1 |
| | % EGFP(+)/GAFP(+) EGFP-Stability in CNS | AAVx/AAV9 | >1 | 0.5-1 | 0.25-0.5 | <0.1 |
| | Spinal Cord | Day 90/Day 14 | >0.75 | 0.5-0.75 | 0.25-0.5 | <0.25 |
| | Brain | Day 90/Day 14 | >0.75 | 0.5-0.75 | 0.25-0.5 | <0.25 |
| 2). Non-CNS tissue targeting | | | | | | |
| | Liver-EGFP+ | AAVx/AAV9 | <0.1 | 0.25-0.5 | 0.5-1 | >1 |
| | Heart-EGFP+ | AAVx/AAV9 | <0.1 | 0.25-0.5 | 0.5-1 | >1 |
| | Pancreas-EGFP+ | AAVx/AAV9 | <0.1 | 0.25-0.5 | 0.5-1 | >1 |
| | *VG Biodistribution | AAVx/AAV9 | <1 | 1-10x | 10-100x | >100x |
| 3). Toxicity | | | | | | |
| | Liver histopathology | Histological grading | 0 | 1 | 2 | 3 |
| | Brain histopathology | Histological grading | 0 | 1 | 2 | 3 |
| | LFTs | AAVx/Naïve | <1 | 1-2x | 2-5x | >5x |
| III. Selection of 2 CCVs from 3 LCVs and AAV9 in Chimpanzees (single-dose, 3 animals/vector) | | | | | | |
| Gene Transfer | | | | | | |
| | Ch-A1AT-c-myc exp | AAVx/AAV9 | >1 | 0.5-1 | 0.25-0.5 | <0.1 |
| | Exp. Stability | Day 7/Day 35 | >0.75 | 0.5-0.75 | 0.25-0.5 | <0.1 |
| Immunology | | | | | | |
| | Capsid T cells | ELISPOT (sfu/$10^6$ cells) | <50 | 50-150 | 150-500 | >500 |
| | Transgene T cells | ELISPOT (sfu/$10^6$ cells) | <50 | 50-150 | 150-500 | >500 |
| | Antibody to capsid | AAVx/AAV9 | <1 | 1-2x | 2-5x | >5x |
| Toxicity | | | | | | |
| | LFTs | AAVx/AAV9 | <1 | 1-2x | 2-5x | >5x |

*VG Biodistribution: vector genome biodistribution is computed as the sum of copy number detected in spinal cord and Brain divided by the sum of copy number detected in all other 9 tissues. The higher the ratio, more CNS restricted.

In a first round of screening, two major aspects of vector biology (pre-existing immunity and gene transfer efficiency in the CNS) in 4 parameters (in vitro NAB assay, in vivo adoptive transfer/liver transduction inhibition assay, EGFP gene transfer to the brain and spinal cord) are analyzed for all candidate vectors and compared with those of AAV9 in both neonatal and adult mice. Three LCVs are selected based on the sum of all scores of 6 parameters with the best theoretical score equal to 0 and the worst theoretical score equal to 18 (in vitro NAB=3, passive transfer=3, Neonate brain EGFP=3, Neonate spinal cord EGFP=3, adult brain EGFP=3, and adult spinal cord EGFP=3) (Table 6). These LCVs are subjected to further analyses in mice and chimpanzees In a second round of selection, LCVs at 3 different doses are evaluated in two strains of neonatal and adult mice and compared to AAV9 in 13 scoring categories. For the cell type tropisms in the mouse CNS, 3 different cell type specific markers are used for identifying neurons, astrocytes and motor neurons (Table 7). Gene transfer efficiency is estimated by the percentage of EGFP positive cells in each cell type. The stability of gene transfer is scored by the ratio of percentages of EGFP positive cells at days 14 and 90. The safety assessments in mice include brain and liver histopathology, LFTs, EGFP expression in liver, heart and pancreas, and biodistribution in 9 non-CNS tissues (lung, heart, spleen, liver, colon, kidney, pancreas, skeletal muscle and gonad). Since the vectors are delivered intravascularly to the CNS, the vector(s) with more limited biodistribution in non-CNS tissues are typically the more favorable candidate(s). The lowest theoretic accumulated score is zero and the highest is 39 for all 13 parameter.

TABLE 7

CNS Cell Type Specific Markers

| Cell | Marker | Antibody | Manufacturer |
|---|---|---|---|
| Neuron | NeuN | Mouse anti-NeuN | Millipore |
| Astrocyte | GFAP | Guinea Pig anti GFAP | Advanced immunochemical |
| Motor neuron (in spinal cord) | ChAT | Goat anti-ChAT | Millipore |

In additional to the phylogentic and physiological closeness to human, another reason to choose chimp as the systemic vector delivery model to select CCVs from the LCVs is the chimp origin of those AAV9 variants. Evaluation of chimp AAV vectors in a chimp model is informative in many aspects of the vector biology, particularly in the pre-existing B and T cell immunity and their impact on the vector performance. The chimp study is focused on two aspects of vector biology: efficiency and stability of gene transfer and safety profiles. To mimic intravascular delivery of the vectors to the CNS and study its impact on host responses, the vectors expressing chimpanzee α1-antitrypsin with a c-myc tag in the C terminal (chA1AT-c-myc) is used and administered intravenously at a dose of $1 \times 10^{12}$ GC/kg for noninvasive monitoring of this secreted reporter gene for gene transfer efficiency and stability in live animals without necropsy. Serum chA1AT-c-myc is measured at different time points after gene transfer to the primary surrogate tissue liver (days 7, 14, 21, 28 and 35). In terms of safety profiles, at these same time points, blood samples are also taken for isolating serum for liver function tests and peripheral blood mononuclear cells (PBMCs) for measuring capsid and chA1AT-c-myc specific T cells using the interferon γ Elispot assay. To study B cell response to vector capsid, neutralizing antibodies to corresponding AAV vectors in the serum samples are analyzed by the in vitro NAB assay. LCVs are ranked based on the sum of all scores of 6 parameters with the best theoretical score equal to 0 and the worst theoretical score equal to 18. CCVs are selected from LCVs and AAV9 based on their ranks in the performance in two strains of mice and chimpanzees. These CCVs are further investigated in neonatal and adult marmoset monkeys according to methods disclosed herein.

Screening of the Candidate Vectors for Pre-Existing B Cell Immunity in Humans

Pre-existing B cell immunity to vector capsid in gene therapy recipients is a first immunological barrier to viral vector mediated gene transfer. Thus, B-cell immunity is a factor in clinical vector development and a selection criterion for vector biology evaluation. Commercially available clinical grade human IVIG is an Ig preparation pooled from more than 60,000 random blood donors, which is considered to be a good representation of the existing B cell immunity to different AAVs that are prevalent in human populations. This reagent is used in two different assays to assess the potential of pre-existing immunity in humans to inhibit gene transfer by those set of vectors. First, the vectors are screened using a well established transduction inhibition assay which measures the reciprocal of the greatest dilution of human immunoglobulin (intravenous) (IGIV) that inhibits transduction (10). Secondly, the clones passed the in vitro neutralizing antibody (NAB) test are studied for the functional consequences of pre-existing immunity in the passive transfer experiments in which pooled human Ig is injected IV into CB6F1 hybrid mice 24 and 2 hours before IV injection of EGFP expressing vector (1011 GCs per animal). Each group (N=5) receives a different dose of human Ig—0, 0.12, 0.4, 1.2, 12 and 40 mg total dose. Assessment for the functionality of NAB to each vector is based on the lowest dose which demonstrates a significant inhibition of transduction as measured by EGFP transduction in liver at 28 days after gene transfer. Quantification of the expression levels of GFP in liver is carried out as previously described (21), Inhibition at only high doses of Ig indicates less interference of gene transfer and lower levels of NAB. AAV9 vector serves as a control and bench marker for both the in vitro and in vivo screening as described in Table 6.

Evaluation of the Candidate Clones in C57BL/6 Mice for the CNS Gene Transfer

A recent study by Foust et al presented evidence that cell type tropisms of AAV9 vector delivered to mouse CNS intravascularly are influenced by the developmental stage of the CNS (9). Apparently, AAV9 targets neurons efficiently in the CNS of neonates but astrocytes in the CNS of adults, which can be explained by the developmental changes in the nature of the cells surrounding the blood vessels in the CNS as well as the structure and molecular composition of the brain extracellular space (22). Considering potentially different applications in different CNS disorders, these novel AAV9 variants are evaluated in both neonatal and adult C57BL/6 mice. AAV9 vector is included in the evaluation and its performance may serve as the bench marker for new vectors. For the first round of vector screening, both neonatal (estimated body weight as 2 grams) and adult (estimated body weight as 20 grams) mice receive the vectors at a dose of $1 \times 10^{14}$ GCs/kg and are necropsied 2 weeks later to harvest the brain and spinal cord tissues for analysis. Specifically, one litter of single housed neonatal-day-1 pups is anesthetized and injected with each vector through the temporal vein. The animals are euthanized at 2 weeks after vector injection. The spinal cords and brains are harvested and fixed. For the vector evaluation in adult mice, 6 of 10 weeks old animals are infused with each vector via tail vein injections. The animals are euthanized 2 weeks later and transcardially perfused with 0.9% saline, then 4% paraformaldehyde. The spinal cords and brains are harvested. For histological processing of the spinal cords and brains, the fixed tissues are transferred to a 30% sucrose and cryo-sectioned into 40μ thick sections for microscopic analysis. In order to perform semi-quantitative unbiased sterological assessment of EGFP transduction in the CNS, the EGFP positive cells in 3 regions of the brain (retrosplenial/cingulate, dentate gyms, and Purkinje cells) and the lumbar spinal cord is counted. The total numbers of EGFP positive cells in each region are computed and compared to those in the AAV9 group. Three LCVs are selected from testing vectors based on their serological reactivity to hIVIG as well as total numbers of EGFP positive cells in either brain or spinal cord or all regions regardless their cell types.

Further Characterization of LCVs and AAV9 in Two Strains of Mice

Differences in the gene transfer efficiency in the liver by AAV2 vector between different mouse strains have been previously described (23). Vector biology of LCVs and AAV9 is evaluated in two different strains of mice, C57BL/6 and BALB/c. Both of them are commonly used for AAV gene transfer studies. The evaluation is conducted in both neonatal and adult mice at several different vector doses: 0.3-, 1- and $3 \times 10^{14}$ GC/kg. The animals are necropsied for analysis at days 14 and 90. The neonatal animals used in this study are from litters of C57BL/6 and BALB/c Day-1 neonates for each vector and each dose for necropsy at days 14 and 90. The adult animals are studied in the same way with 6 animals per vector, per dose and per time point. For this study, a total of 15 parameters are analyzed but they can be distilled down to 4 specific criteria: tropism and efficiency (% of EGFP positive neurons, motor neurons and astrocytes in the brain and spinal cord), stability of EGFP expression in the brain and spinal cord (Day 90/Day 14), non-CNS tissue targeting (EGFP expression in liver, heart and pancreas and the ratio of total vector genome copies in the CNS and the sum of vector genomes detected in all 9 non-CNS tissues) and vector related toxicity (brain and liver histopathology and serum transaminase levels).

Evaluation of LCVs and AAV9 in Chimpanzees

Evaluation of AAV vectors in mice has contributed to vector discovery and development, but vector performance in mice has not been always successfully translated into that in large animal models, particularly in vector related immune responses, perhaps due to the complexity of the adaptive immune response repertoire in higher primates (including humans) as compared with rodents. Chimpanzees are the closest relative to humans genetically in the animal kingdom. Furthermore, chimps have been shown to share virus host ranges with humans to a greater extent than any other species. This includes a variety of respiratory tract pathogens, such as respiratory syncytial virus (RSV), a number of lentiviruses, and hepatitis C virus Chimpanzees are natural hosts of transcriptionally active AAV9 variants. Therefore, chimps provide a model system to study the immunological properties of primate AAVs, particularly those isolated from the chimpanzee. The data generated in chimps can predict safety and immunity in humans. LCVs and AAV9 vectors that express a secreted reporter gene are delivered intravenously to a cohort of chimpanzees (n=3 per vector). Live animals are monitored for gene transfer, T cell responses to vector capsid proteins and to transgene product as well as antibody formation against vector capsid in blood samples. The animals are pre-screened for the presence of the neutralizing antibodies against the vector capsids. Those animals with undetectable NAB levels at the sensitivity of the NAB detection assay are enrolled for the study.

In order to dissect the capsid T cell response from that of the transgene, the endogenous chimp α1-anti-tryspin gene is used to avoid eliciting immune responses that could be caused specifically by crossing species. Another reason to use this secreted report is to noninvasively monitor the transgene expression in blood. This chimp gene has been PCR-cloned. A c-myc tag is fused to the C terminal of the chimp-A1AT cDNA for detection by ELISA. The short c-myc-epitope is highly conserved across species and should not be immunogenic, but is detectable with anti-c-myc antibody reaction in this ELISA. This strategy was used successfully with c-myc-tagged baboon AAT (24).

An Interferon-γ-ELISPOT assay may be used to detect both AAV capsid and transgene specific T cells in chimp PBMCs. For these assays, peptide libraries of the capsid proteins of LCVs and AAV9, and chimp-A1AT are synthesized using standard techniques.

The decision on selecting CCVs is based on the data sets generated in: 1.) initial screening of clones by serological and gene transfer assays, using AAV9 as the reference, to select LCVs; 2.) further characterization of LCVs and AAV9 in two strains of mice, and 3.) evaluation of LCVs and AAV9 in the chimp model of systemic vector administration for the efficiency and stability of transgene expression, toxicity, activation of T cells to capsid and transgene product. Serological reactivity and total numbers of GFP positive cells is compared in order to evaluate the pre-existing immunity to each vector in a representative human population and the efficiency [total # of EGFP (+) cells in the CNS] of each vector in both neonatal and adult mice. The data are analyzed using the ANOVA method, where the serological reactivity and total numbers of EGFP positive cells are used as outcome variables and vector types and age groups as the two predictive factors. With a subset of candidate vectors passing the serological tests in vitro and in vivo, this experiment involves at least 2 factors, i.e., the number of types of vector, and the number of age groups. For example, based on 7 vectors and 2 age groups, there are 7×2=14 experimental groups, if each group has 6 experimental subjects (mice), data from 14×6=84 animals is used for this analysis. Potential differential effects of vector type by age group are examined by including interaction (cross-product) term of vector type and age group indicators in the ANOVA model. Relative contributions of vector type and age group to the total variations in the outcome measures are also evaluated. The results are used to identify optimal vector type and age group combinations.

Vector performance scores are also used to select LCVs; LCVs with the lowest scores and low variability in performance are typically selected. Selection is based on rating 15 parameters in 4-key criteria at a scale of 0-3. ANOVA methods are used to analyze the data generated in this phase. For example, this phase of the experiment may involve 5 factors, including vector type (3), doses of vector (3), strains (2), age groups (2), and time points (2). In this example, there are 3×3×2×2×2=72 unique combinations. If, for each combination, observations on 6 animals are available for analysis, in total, data on 72×6=452 animals are used for this analysis. In order to test potential differential dose effects between vector types, interaction terms (cross-product terms) between vector and dose variables are included in the ANOVA models. Significant interaction terms imply possible existence of differential dose effects by vector type. The results facilitate identification of optimal vector type-dosage combinations. Relative contributions from the five factors to the total variations in the performance scores are evaluated, which provide a basis for eliminating factors that are not important to the total performance in future experiments. The extent to which the variances are homogenous across various levels of the five factors are evaluated. Any combinations with excessive variations are not considered candidate conditions in future experiments due to potentially unstable/unreliable experimental outcomes. The outcome variable is expected to be normally distributed. The normality assumption for ANOVA analysis appears realistic. In cases where the variable has a skewed distribution (e.g., Poisson), a logarithmic transformation is applied to the data.

Sample size and statistical power considerations: Inbreed mouse strains are used for experiments, variation between animals under the same controlled experimental condition is considered to be very small, and thus 6 animals per experimental condition is justified. Power analyses are conducted as data is generated and proper adjustment to the group sizes is made as necessary. Sample size for the chimpanzee study is small due to restricted animal resources. ANOVA methods are not always applicable. In some cases, we provide only descriptive statistics without formal statistical testing.

Further Characterization of Intravascularly Delivered CCVs for the CNS Gene Transfer in Marmoset Monkeys Structural differences among novel AAV9 variants leads to their functional differences in neuronal and neuroglial cell tropism, efficiency and stability of CNS transduction, vector related toxicity, and immunological properties in NHPs. Systemic delivery of LCVs to chimpanzees provides critical data to assess the vector toxicity, the T cell immunities towards both vector capsids and transgene as well as the B cell immunities against different vector capsids. Intravascular delivery of a secreted reporter gene transfer in chimpanzees also enables an evaluation of gene transfer efficiency and stability in the surrogate tissue (primarily liver). Vector candidate(s) suitable for clinical development of the CNS directed gene therapy, are identified by evaluating the candidate vectors in a NHP CNS gene transfer model. Marmoset monkeys are useful as the model for the CNS gene transfer. Found originally in the forests of South America, marmoset monkeys are thought to be phyletic dwarfs that have evolved from a larger ancestor. They have many genetic and physiological similarities to humans. The common marmoset (*Callithrix jacchus*) has several advantages as an experimental animal model. The small size of the common marmoset (approximately 300-600 g) reduces the vector production burden remarkably and makes it easier to handle relative to larger Old World monkeys. As laboratory animals, marmosets also have reduced cost and safety hazards in comparison to Old World monkeys. They can live up to 15 years in captivity, with breeding pairs giving birth to twins (about 100 grams each) every 5 months (25). Therefore, these marmosets can be easily reproduced in the laboratory setting, making possible supply of large numbers of marmosets with consistent microbiological and genetic quality. Marmoset monkeys have been used to investigate a variety of CNS-related diseases, especially for the research of Parkinson's disease and Huntington's disease, as summarized in a review paper (26). In fact, marmosets are the one of the most extensively used NHP models in biomedical research. The marmoset study is carried out in both neonatal and adult animals. CCVs are evaluated by 18 measurements in 5 categories: tropism and efficiency in the CNS, stability in the CNS, non-CNS tissue targeting, immune responses and toxicity, using a scoring system similar to that used for selection of the CCVs in mice and chimps.

Experimental Design

CCVs are extensively evaluated in marmosets for cell type tropism, gene transfer efficiency and stability in the CNS, non-CNS tissue targeting and gene expression, CNS and liver pathology, transgene and capsid immunities and vector related toxicity as summarized in the Table 8.

Capsid and Transgene Immunities

Analyses of capsid and transgene T cells are performed on both PBMCs during the live phase of the marmoset studies and lymphocytes isolated from different lymphoid tissues at the necropsies. Below is a list of PBMCs collected at different time points and tissues collected at the necropsies.

PBMCs: Day 7 prior to vector injection, days, 14, 28, and 35 post vector infusion

TABLE 8

Study Design for Marmoset Monkey Experiments

| Age/animal# | Parameter | Measurement | Rating | | | |
|---|---|---|---|---|---|---|
| | | | 0 | 1 | 2 | 3 |
| Postnatal-Day-1 (20 total) | 1. Tropism and efficiency | | | | | |
| n = 4 | Spinal cord | % EGFP(+)/ChAT(+) | >75 | 75-50 | 50-25 | <25 |
| per vector (3 x $10^{14}$ GC/kg) | | % EGFP(+)/GAFP(+) | >75 | 75-50 | 50-25 | <25 |
| per time point (Days 7 and 35) | Brain | % EGFP(+)/NeuN(+) | >75 | 75-50 | 50-25 | <25 |
| n = 4, PBS control | | % EGFP(+)/GAFP(+) | >75 | 75-50 | 50-25 | <25 |
| Adult (20 total) | 2. EGFP-stability in CNS | | | | | |
| n = 4 | Spinal cord: Motor N | Day 7/Day 35 | >0.75 | 0.5-0.75 | 0.25-0.5 | <0.25 |
| per vector (3 x $10^{14}$ GC/kg) | Astrocytes | Day 7/Day 35 | >0.75 | 0.5-0.75 | 0.25-0.5 | <0.25 |
| per time point (Days 7 and 35) | Brain: Neuron | Day 7/Day 35 | >0.75 | 0.5-0.75 | 0.25-0.5 | <0.25 |
| n = 4, PBS control | Astrocytes | Day 7/Day 35 | >0.75 | 0.5-0.75 | 0.25-0.5 | <0.25 |
| | 3. Non-CNS tissue targeting | | | | | |
| | Transduction | % EGFP(+) | <10 | 10-30 | 30-60 | >60 |
| | Liver | % EGFP(+) | <10 | 10-30 | 30-60 | >60 |
| | Heart | % EGFP(+) | <10 | 10-30 | 30-60 | >60 |
| | Pancreas | % EGFP(+) | <10 | 10-30 | 30-60 | >60 |
| | VG Biodistribution | GC, CNS/GC, 9 tissues | >$10^{-2}$ | >$10^{-3}$ | >$10^{-4}$ | >$10^{-5}$ |
| | 4. Immune responses | | | | | |
| | Cap T cells | ELISPOT (sfu/$10^6$ cells) | <50 | 50-150 | 150-500 | >500 |
| | EGFP T cells | ELISPOT (sfu/$10^6$ cells) | <50 | 50-150 | 150-500 | >500 |
| | NAB to vector cap | Reciprocal titer | <$1/10^2$ | <$1/10^3$ | <$1/10^4$ | >$1/10^5$ |
| | 5. Toxicity | | | | | |
| | brain pathology | Histological grading | 0 | 1 | 2 | 3 |
| | liver histopathology | Histological grading | 0 | 1 | 2 | 3 |
| | LFTs | PBS/vector | <1 | 1-2x | 2-5x | >5x |

Assessment of CCVs in Neonatal and Adult Marmoset Monkeys for CNS Gene Transfer

CCVs are further investigated in both neonatal and adult marmosets. The adult animals are pre-screened for neutralizing antibodies against CCVs by the in vitro transduction inhibition assay. The neonatal animals are produced by programmed pregnancy. The mothers are identified for programmed pregnancy based on their neutralizing antibody titers to the vectors. The pregnant mothers are tested again for the NAB titers 2 weeks before the due dates. The highest vector dose (3×$10^{14}$ GC/kg) used for the neonatal and adult mice is the vector dose for both neonatal and adult marmosets. For the neonatal study, a total of 20 animals are enrolled to evaluate CCVs. Four out of 20 animals receive PBS injection and serve as the controls. Eight postnatal-day-1 animals are infused with each of CCVs, out of which 4 animals each is necropsied at days 7 and 35 for analysis. A total of 20 adult male animals are used in this study in a design identical to that of the neonatal marmosets. Spinal cord and brain tissues are harvested at the necropsies. The fixed tissues are cryo-sectioned and subjected to immunofluorescent staining for the cell markers listed in the Table 3 to label neurons, astrocytes and motor neurons followed by microscopic examination. Percentages of EGFP positive cells in each cell types indifferent regions of the brain and spinal cord at different time points are computed to assess cell typetropism, spreading and stability of the EGFP gene transfer by 2 CCVs.

Tissue lymphocytes: Liver, peritoneal lavage, spleen, and axillary, inguinal, iliac and mesenteric lymph nodes For the neonatal animals, pre-vector PBMCs are sampled at the time of injection. IFN-γ ELISPOT assays are carried out for all of those samples to detect capsid and EGFP specific T cells. At each bleed, serum samples are also collected for the NAB assay to determine the B cell responses to the viral vector capsids.

Vector Related Toxicity and Non-CNS Bio-Distribution

During the live phase of the study and the time of necropsy, serum transaminase levels (LFTs for ALT and AST) of the study animals are monitored to investigate potential vector related liver toxicity. At the time of necropsy, a part of brain and liver tissues are fixed, paraffin embedded, sectioned and stained for histopathology study. To inspect EGFP transduction in non-CNS tissues, liver, heart and pancreas tissues are collected for fixation, cryo-section and microscopic examination. Finally, in addition to the brain and spinal cord, a panel of 9 tissues (lung, heart, spleen, liver, colon, kidney, pancreas, skeletal muscle and gonad) is collected at the necropsy for real time PCR quantification of the persisted vector genomes.

Statistical Analysis and Alternative Strategies

Vector type (e.g., 2), age groups (e.g., 2), and time points (e.g., 2) are 3 main factors involved in this experiment. Those factors are translated into, e.g., 2×2×2=8 unique combinations, each of which has 4 experimental animals. In total, data on, e.g., 8×4=32 animals is available for the statistical analysis. In this study, 4 animals that receive PBS from each age group serve as the baseline to better assess the vector related toxicity. ANOVA methods are used for data analysis. The outcomes of the study are informative for deciding which CCVs should be advanced for clinical application. A concern over the CNS targeting of gene therapeutics through systemic vector delivery is the potentially harmful consequences of high levels of ectopic expression of the CNS genes in other tissues. The extent to which identified CCVs have CNS restricted biodistribution is addressed by employing the CNS specific promoter or microRNA regulation or both in our expression cassettes to de-target transgene expression from other tissues and cell types, particularly those involved with cellular immunity. Both strategies have been used to de-target the liver from transgene expression (27).

References for Example 5:

1. Fu H, Muenzer J, Samulski R J, et al. Self-complementary adeno-associated virus serotype 2 vector: global distribution and broad dispersion of AAV-mediated transgene expression in mouse brain. Mol Ther 2003; 8:911-7.
2. Gao G, Lu Y, Calcedo R, et al. Biology of AAV serotype vectors in liver-directed gene transfer to nonhumanprimates. Mol Ther 2006; 13:77-87.
3. Manno C S, Pierce G F, Arruda V R, et al. Successful transduction of liver in hemophilia by AAV-Factor IX and limitations imposed by the host immune response. Nat Med 2006; 12:342-7.
4. Mandel R J, Manfredsson F P, Foust K D, et al. Recombinant adeno-associated viral vectors as therapeutic agents to treat neurological disorders. Mol Ther 2006; 13:463-83.
5. Gao G P, Alvira M R, Wang L, Calcedo R, Johnston J, Wilson J M. Novel adeno-associated viruses from rhesus monkeys as vectors for human gene therapy. Proc Natl Acad Sci USA 2002; 99:11854-9.
6. Gao G, Alvira M R, Somanathan S, et al. Adeno-associated viruses undergo substantial evolution in primates during natural infections. Proc Natl Acad Sci USA 2003; 100: 6081-6.
7. Gao G, Vandenberghe L H, Alvira M R, et al. Clades of Adeno-associated viruses are widely disseminated in human tissues. J Virol 2004; 78:6381-8.
8. Gao G, Vandenberghe L H, Wilson J M. New recombinant serotypes of AAV vectors. Curr Gene Ther 2005; 5:285-97.
9. Foust K D, Nurre E, Montgomery C L, Hernandez A, Chan C M, Kaspar B K. Intravascular AAV9 preferentially targets neonatal neurons and adult astrocytes. Nat Biotechnol 2009; 27: 59-65.
10. Calcedo R, Vandenberghe L H, Gao G, Lin J, Wilson J M. Worldwide epidemiology of neutralizing antibodies to adeno-associated viruses. J Infect Dis 2009; 199:381-90.
11. Arbetman A E, Lochrie M, Zhou S, et al. Novel caprine adeno-associated virus (AAV) capsid (AAV-Go.1) is closely related to the primate AAV-5 and has unique tropism and neutralization properties. J Virol 2005; 79:15238-45.
12. Schnepp B C, Jensen R L, Chen C L, Johnson P R, Clark K R. Characterization of adeno-associated virus genomes isolated from human tissues. J Virol 2005; 79:14793-803.
13. Carter B J, P. Trempe J, Mendelson E. Adeno-associated virus gene expression and regulation. In: Tijssen P, editor. Handbook of parvoviruses. Boca Raton: CRC Press Inc.; 1990. p. 227-54.
14. Vandenberghe L H, Wilson J M, Gao G. Tailoring the AAV vector capsid for gene therapy. Gene Ther 2009; 16:311-9.
15. Tamura K, Dudley J, Nei M, Kumar S. MEGA4: Molecular Evolutionary Genetics Analysis (MEGA) software version 4.0. Mol Biol Evol 2007; 24:1596-9.
16. Arnold K, Bordoli L, Kopp J, Schwede T. The SWISS-MODEL workspace: a web-based environment for protein structure homology modelling. Bioinformatics 2006; 22:195-201.
17. Mingozzi F, Maus M V, Hui D J, et al. CD8(+) T-cell responses to adeno-associated virus capsid in humans. Nat Med 2007; 13:419-22.
18. Akache B, Grimm D, Pandey K, Yant S R, Xu H, Kay M A. The 37/67-kilodalton laminin receptor is a receptor for adeno-associated virus serotypes 8, 2, 3, and 9. J Virol 2006; 80:9831-6.
19. Fisher K J, Gao G P, Weitzman M D, DeMatteo R, Burda J F, Wilson J M. Transduction with recombinant Adenoassociated virus for gene therapy is limited by leading-strand synthesis. J Virol 1996; 70:520-32.
20. Roy S, Gao G, Lu Y, et al. Characterization of a family of chimpanzee adenoviruses and development of molecular clones for gene transfer vectors. Hum Gene Ther 2004; 15:519-30.
21. Scallan C D, Jiang H, Liu T, et al. Human immunoglobulin inhibits liver transduction by AAV vectors at low AAV2 neutralizing titers in SCID mice. Blood 2006; 107:1810-7.
22. Lowenstein P R. Crossing the rubicon. Nat Biotechnol 2009; 27:42-4.
23. Wang L, Calcedo R, Nichols T C, et al. Sustained correction of disease in naive and AAV2-pretreated hemophilia B dogs: AAV2/8-mediated, liver-directed gene therapy. Blood 2005; 105:3079-86.
24. Song S, Scott-Jorgensen M, Wang J, et al. Intramuscular administration of recombinant adeno-associated virus 2 alpha-1 antitrypsin (rAAV-SERPINA1) vectors in a nonhuman primate model: safety and immunologic aspects. Mol Ther 2002; 6:329-35.
25. Abbott D H, Barnett D K, Colman R J, Yamamoto M E, Schultz-Darken N J. Aspects of common marmoset basic biology and life history important for biomedical research. Comp Med 2003; 53:339-50.
26. Mansfield K. Marmoset models commonly used in biomedical research. Comp Med 2003; 53:383-92.
27. Xie J, Su Q, Xie Q, Mueller C, Zamore P, Gao G. MicroRNA regulated tissue specific transduction by rAAV vector. American Society of Gene Therapy Annual Meeting. San Diego; 2009.

Example 6

Sensitive Detection and Characterization of AAV Contamination in Producer Cell Lines for Recombinant Biologics AAV viruses are very stable and easily aerosolized. The life cycle of AAV consists of two stages: a latent stage and a replication stage. In the absence of adenovirus, AAV infects host cells in a very stealthy manner to establish its latency. Early studies with wild type AAV infection of cell lines in vitro suggested that AAV site-specifically integrated into human Chromosome 19 q 13, although, as yet, no direct evidence supports the site specific integration of AAV in vivo. Only when helper functions are provided by co- or subsequent infection of Adenovirus or HSV are the latent AAV genomes rescued, replicated and packaged into infectious virions. The primary adenovirus genes with helper functions for AAV replication and packaging include E1a, E1b, E2a, E4 and VARNA. However, extensive studies with recombinant AAV, in the absence of selective pressure, have revealed that rAAV genomes are colonized in the host nuclei primarily as the episomal forms such as high molecular weight linear concatomers, and circular monomer and concatamers.

Due to its capability of being aerosolized and existing as a latent and persistent infection, contamination of commonly used cell lines by AAV is becoming a major issue for the cell line based GMP manufacturing of recombinant biologics. Some major challenges in the detection and characterization of stealthy infection of cell lines by AAV include the lack of any microscopically visible pathological effect, primarily episomal persistence of AAV genomes that leads to a dilutional effect after cell divisions and inconsistency in their detection, and a high rate of AAV contamination in adenovirus preparations when used as helper virus for AAV rescue studies. When PCR based molecular methods are employed for the rescue of AAV sequences from testing cell lines, several technical obstacles negatively impact the detection and characterization of endogenous AAV proviral sequences. First, in the several contaminated cell lines which were tested, AAV sequences exist in very low abundance (ranging from 0.1 to 0.001 copy per diploid genome), which requires highly efficient and reliable PCR methodology and technical skills to accomplish the sequence amplification. Second, the primer design represents another challenge. Rep genes are usually highly conserved and good targets for primer design and PCR detection. But high sequence homology between rep genes of different AAV serotypes makes serotype identification of different AAVs difficult. On the other hand, the natural diversity of the AAV family is primarily displayed as significant sequence variations in AAV cap genes, which makes diagnosis of AAV identity relatively easy. This kind of target sequence variations also results in difficulties in primer design for PCR amplification of cap genes.

Producer cell clones are examined to detect contamination with low copy numbers of known, or unknown, species of AAV, which persist as episomal proviral genomes and may be transcriptionally active in a latent state. Isolation and characterization of the AAVs may be accomplished through any one or a combination of the following approaches. For example, AAV proviral genomic sequences may be assessed by signature PCRs, cloning (e.g., TOPO cloning), sequencing and bioinformatic analysis. AAV viral RNA transcripts in the contaminated cell clones may be assessed by RT-PCR, cloning, sequencing and bioinformatic analysis. AAV proviral sequences in the contaminated cells may be rescued by providing adenovirus helper functions to the contaminated producer cell clone(s).

Analysis of AAV Proviral Genomic Sequences Using Signature PCR:

Detection of AAV proviral genomic sequences using short signature PCR achieves a detection limit of 1-10 copies of AAV cap sequence in the background of mouse liver total cellular DNA. Short signature PCR uses a primer set that can anneal to and amplify a signature region (about 260 bp) in the hypervariable region 2 of VP1 of most of AAV cap gene.

Detection of AAV proviral genomic sequences using long signature PCR achieves a detection limit of 10 copies of AAV cap sequence in the background of mouse liver total cellular DNA. Long signature PCR using primer sets are used that can anneal to and amplify a genomic region (spanning 800 bp of rep and 2.2 kb of entire cap VP1 gene or just 2.2 kb of the entire cap VP1 gene) of most of AAV serotypes and genotypes.

Protocol:
Detection, isolation and characterization of AAV proviral sequences in the testing articles by signature PCR, Topo cloning, sequencing and bioinformatic analysis.

1). Testing articles and controls:
  a. Testing articles: cellular DNAs from AAV strong positive, weak positive and negative cell clones
  b. Positive control: Detroit 6-7374 cells. This is AAV latently infected Detroit 6 cell line which has 0.1-1 copy per cell of latent AAV genome (Bern K I et al, 1975, Virology 68(2):556-560; Kotin R M and Berns K I, 1989, Virology 170(2): 460-467; Kotin R M et al., 1990, J. Virol. 87-2211-2215 and Gao et al., unpublished data).
  c. Negative controls: total cellular DNAs from original ATCC 293 cells, Invitrogen 293 cells and naïve mouse liver.
  d. pAAV2rep/cap plasmid is used to spike into total cellular DNA of either AAV free 293 cells or naïve mouse liver as copy number references to monitor the sensitivity of the PCR detection.

2). Primer sets used:
  AV2 as/AV1ns (3 kb rep+cap)
  AV2 as/19S (1.6 kb cap)
  CapF/AV2cas (2.2 kb cap)
  19S/18 as (0.26 kb cap)
  Rep3/rep5 (0.44 kb rep)

3). PCR and cloning reagents:
  Cellular DNA extraction kit
  DNase/RNase free water
  PCR kit
  PCR purification kit
  Gel purification kit
  Topo cloning kit
  Competent cells
  Ligation and other cloning reagents
  Various restriction enzymes
  Antibiotics for cloning
  DNA molecular weight markers 4). Outline of the experiment:
  (1). Assay development. To optimize PCR conditions with different primer sets using various copy numbers of pAAV2rep/cap plasmid DNA as well as their counterparts spiked into cellular DNA of either clean 293 cells or mouse liver to determine sensitivity of the PCR assay and potential interference of cellular DNA to AAV target specific detection.
  (2). Workflow. Various cell clones of testing article as well as positive and negative controls; total cellular DNA extraction; perform PCR together with copy number reference controls spiked into AAV free cellular DNA; gel electrophoresis; cloning PCR positive fragments; restriction mapping analysis for gross identification; sequence analysis and bioinformatic analysis to confirm the identity.

Analysis of AAV Proviral RNA Transcript Sequences Using RT-PCR:

AAV viral RNA transcripts are analyzed by combining reverse transcription reaction with the highly sensitive PCR designs (short and long signature PCR) described above.

Protocol:
Detection, isolation and characterization of AAV viral RNA transcripts in the contaminated cell clones.

1). Testing Articles and Controls:
  a. Testing articles: AAV strong positive, weak positive and negative cell clones based on the data from contracted testing labs.
  b. Positive control: Detroit 6-7374 cells. This is AAV latently infected Detroit 6 cell line which has 0.1-1 copy per cell of latent AAV genome (Bern K I et al, 1975, Virology 68(2):556-560; Kotin R M and Berns K I, 1989, Virology 170(2): 460-467; Kotin R M et al., 1990, J. Virol. 87-2211-2215 and Gao et al., unpublished data).

c. Negative controls: Original ATCC 293 cells, Invitrogen 293 cells and naïve mouse liver.

d. pAAV2rep/cap plasmid is used to spike into total cellular DNA of either AAV free 293 cells or naïve mouse liver as copy number controls to monitor the sensitivity of the PCR detection.

e. Infectious clones of pAd5 plasmid is used for activating latent AAV transcription in the positive control Detroit 6-7374 cells, while pAd helper plasmid is transfected into the 293 cell-based testing cell clones for initiating viral RNA transcription of contaminating AAV sequences.

2). Primer Sets Used for Conventional PCR and RT-PCR:
AV2 as/19S (1.6 kb cap)
CapF/18 as (700 bp cap)
CapF/AV2cas (2.2 kb cap)
19S/18 as (0.26 kb cap)
Rep3/Rep5 (0.44 kp rep)

3). Primer and Probe Sets Used for Real Time PCR and RT-PCR:
Rep1F/Rep1R
Cap1F/Cap1R 4). Tissue Culture, RNA Extraction, RT-PCR and Cloning Reagents:
Standard tissue culture reagents
DNA transfection reagents
Trizol
Qiagen RNAeasy kits
RNase free-DNase I
RNase Zap
DNase and RNase free water
High capacity reverse transcription kit
One step qRT-PCR kit
Real time PCR master mix
Real time PCR primer/probe sets
Conventional PCR reagent
Topo cloning kit
Ligation and other cloning reagents
Various restriction enzymes
Antibiotics for cloning
DNA and RNA molecular weight Markers 4). Outline of the Experiment The positive control Detriot-6-7374 cells, AAV free-negative control cells and testing cell clones are cultured with or without transfection of adenovirus helper plasmids for 48 hours. Total cellular RNA is prepared from each culture with or without DNase treatment. The conventional and real time RT-PCR reactions are set up for each sample that has undergone the following treatments.

a. RNA samples not treated with DNase I b. RNA samples treated with DNase I but not with reverse transcriptase c. RNA samples treated with both DNase I and reverse transcriptase The PCR products are cloned, characterized by restriction mapping and positive clones are sequenced and subjected to bioinformatic analysis for the identity. Furthermore, relative transcriptional activity of AAV viral genes in the testing cell clones in the presence and absence of adenovirus helper functions are quantified by one step qRT-PCR.

Viral Rescue Assay of AAV Proviral Genomes

For viral rescue of AAV proviral genomes in contaminated producer cell clone(s), adenovirus helper functions are provided by transfecting an Ad helper plasmid that contains all essential helper genes but could not produce any infectious adenovirus. This strategy has the following unique advantages. First, providing helper function by plasmid, not the virus, essentially eliminates the possibility of AAV contaminants that could be brought into the testing process by adenovirus infection. Second, the absence of adenovirus replication and cytopathic effects promotes rescue and replication of AAV in the contaminated cell clone(s).

The sensitivity and reliability of the assay is enhanced by serial passage of crude lysates of the testing article onto either the testing article(s) themselves or clean 293 cells to accomplish biological amplifications of the target signal.

The biological amplified target sequences are isolated, characterized and quantified by the highly sensitive and reliable conventional and real time PCR and RT-PCR assays described above. The combination of biological amplification and efficient PCR amplification further improves the sensitivity of the assay and make it possible to detect very low abundance of AAV sequences in the contaminated cell clones. Particularly, the primer and probe sets for real time PCR quantification of AAV sequences that exist in the original testing article as well as that are biologically amplified in different passages are designed to target the conserved sequences in the AAV genome.

Protocol:

Rescue and characterization of AAV proviral genomes in the contaminated producer cell clone(s).

1). Testing Articles and Controls:

a. Testing articles: AAV strong positive, weak positive and negative cell clones based on the data from contracted testing labs.

b. Positive control: Detroit 6-7374 cells. This is AAV latently infected Detroit 6 cell line which has 0.1-1 copy per cell of latent AAV genome (Bern K I et al, 1975, Virology 68(2):556-560; Kotin R M and Berns K I, 1989, Virology 170(2): 460-467; Kotin R M et al., 1990, J. Virol. 87-2211-2215 and Gao et al., unpublished data).

c. Negative controls: Original ATCC 293 cells, Invitrogen 293 cells and naïve mouse liver.

d. pAAV2rep/cap plasmid is used to spike into total cellular DNA of either AAV free 293 cells or naïve mouse liver as copy number controls to monitor the sensitivity of the assay.

e. Infectious clones of pAd5 plasmid are used for activating latent AAV transcription in the positive control Detroit 6-7374 cells, while pAd helper plasmid is transfected into the 293 cell-based testing cell clones for initiating viral RNA transcription of contaminating AAV sequences.

f. Wild type AAV2 with known infectious titer for assay development.

2). Primer Sets Used for Conventional PCR and RT-PCR:
AV2 as/AV1ns (3 kb rep+cap)
AV2 as/19S (1.6 kb cap)
CapF/18 as (700 bp cap)
CapF/AV2cas (2.2 kb cap)
19S/18 as (0.26 kb cap)
Rep3/Rep5 (0.44 kb rep)

3). Primer and Probe Sets Used for Real Time PCR and RT-PCR:
Rep1F/Rep1R
Cap 1F/Cap 1R 4). Tissue Culture, RNA Extraction, RT-PCR and Cloning Reagents:
Standard tissue culture reagents
DNA transfection reagents
Trizol
Qiagen RNAeasy kits
RNase free-DNase I
RNase Zap
DNase and RNase free water
High capacity reverse transcription kit
One step qRT-PCR kit Real time PCR master mix
Real time PCR primer/probe sets
Conventional PCR reagents
Topo cloning kit
Ligation and other cloning reagents
Various restriction enzymes
Antibiotics for cloning 5). Outline of the Experiment (1). Production of wild type AAV2 virus as the positive control for assay development. pSub201, an infectious molecular clone of AAV2, is co-transfected with pAd helper plasmid into 293 cells for AAV2 rescue and packaging. The virus is purified by 3 rounds of gradient centrifugation. The infectious titer of this wild type positive control AAV is determined by serial dilution/infection and real time PCR based TC-ID50 assay.

(2). Assay development and validation to determine the sensitivity and reproducibility of the infection/passage assay. AAV free-293 cells seeded in 60 mm or 100 mm plates are infected with AAV2 control virus at MOIs of 0, 1, 10, 100 and 1000 in 6 replicates. For 3/6 replicates of each infection, cells are transfected with an infectious molecular clone of Ad5 (pAd5) at 3 hours after the infection. All replicates are harvested at 7 days post-infection and equally divided into 2 parts. One part of each is used for DNA and RNA extraction and real time PCR and RT-PCR analysis. The other part of each cell pellet is re-suspended in 10 mM Tris, pH8.0 and subjected to 3 cycles of freeze/thaw. One third of each lysate is used to passage onto the 2nd sets of 293 cells without additional transfection of pAd5 plasmid. Four days after infection, the cells are harvested and processed as above towards a 3rd passage. Unused viral lysate is stored at −80° C. DNA and RNA samples from each passages are assayed by real time PCR and RT-PCR for quantification. Conventional PCR and RT-PCR is carried out, as needed, for AAV sequence isolation, cloning and sequence confirmation.

(3). Rescue of latent AAV2 from positive control Detroit 6-7374 cells. The cells are seeded in 60 mm or 100 mm plates in 6 replicates. Three of 6 plates are transfected with infectious molecular clone of ad5, pAd5. One week after transfection, the cells is processed and analyzed as described in (2). This will serve as the positive control experiment to demonstrate the capability to rescue and amplify the AAV2 genome in a latent infected cell line by this rescue/passage assay.

(4). Examination of the testing producer cell clones for rescueable AAV provirus contamination. The experiment is carried out as described in (1) and (2) except for the following differences.

a. the conventional PCR and RT-PCR is performed for AAV sequence isolation, cloning, sequencing and bioinformatic analysis to identify the contaminating AAV in the testing cell clones.

b. As an option, if there is indeed rescueable and amplifiable AAV contamination in the producer cell clones, the entire proviral genome may be cloned (from ITR to ITR) as an infectious molecular clone for further characterization.

This invention is not limited in its application to the details of construction and the arrangement of components set forth in this description or illustrated in the drawings. The invention is capable of other embodiments and of being practiced or of being carried out in various ways. Also, the phraseology and terminology used herein is for the purpose of description and should not be regarded as limiting. The use of "including," "comprising," or "having," "containing," "involving," and variations thereof herein, is meant to encompass the items listed thereafter and equivalents thereof as well as additional items.

Having thus described several aspects of at least one embodiment of this invention, it is to be appreciated various alterations, modifications, and improvements will readily occur to those skilled in the art. Such alterations, modifications, and improvements are intended to be part of this disclosure, and are intended to be within the spirit and scope of the invention. Accordingly, the foregoing description and drawings are by way of example only.

SEQUENCE LISTING (249 sequences)

SEQ ID NO: 1 - DNA, 27 bp, Artificial Sequence
  Isolated Molecule
  misc_feature (1)..(1): n is a, c, g, or t
  misc_feature (27)..(27): n is a, c, g, or t
ngaytgyvwhwykgarcaataaatgan

SEQ ID NO: 2 - DNA, 30 bp, Artificial Sequence
  Isolated Molecule
  misc_feature (1)..(1): n is a, c, g, or t
  misc_feature (30)..(30): n is a, c, g, or t
ngaaacgaathaamcggtttattgattaan

SEQ ID NO: 3 - DNA, 25 bp, Artificial Sequence
  Isolated Molecule
gactgtgtttctgagcaataaatga

SEQ ID NO: 4 - DNA, 28 bp, Artificial Sequence
  Isolated Molecule
gaaacgaattaaccggtttattgattaa

SEQ ID NO: 5 - DNA, 24 bp, Artificial Sequence
  Isolated Molecule
  misc_feature (1)..(1): n is a, c, g, or t
  misc_feature (24)..(24): n is a, c, g, or t
nymrwmrwckksagamgcggrmsn

SEQ ID NO: 6 - DNA, 22 bp, Artificial Sequence
  Isolated Molecule
ccatcgacgtcagacgcggaag

SEQ ID NO: 7 - DNA, 26 bp, Artificial Sequence
  Isolated Molecule
  misc_feature (1)..(1): n is a, c, g, or t
  misc_feature (26)..(26): n is a, c, g, or t
nssvgacrsstmscarwwcaraygtn

SEQ ID NO: 8 - DNA, 24 bp, Artificial Sequence
  Isolated Molecule
gccgacaggtaccaaaacaaatgt

SEQ ID NO: 9 - DNA, 24 bp, Artificial Sequence
  Isolated Molecule
  misc_feature (1)..(1): n is a, c, g, or t
  misc_feature (24)..(24): n is a, c, g, or t
nmyggmrygtsarwatytsaaycn

SEQ ID NO: 10 - DNA, 22 bp, Artificial Sequence
  Isolated Molecule
ccggcgtgtcagaatctcaacc

SEQ ID NO: 11 - DNA, 31 bp, Artificial Sequence
  Isolated Molecule
  misc_feature (1)..(1): n is a, c, g, or t
  misc_feature (10)..(10): n is a, c, g, or t
  misc_feature (31)..(31): n is a, c, g, or t
nacrbraganccaaagttcaactgamacgan

SEQ ID NO: 12 - DNA, 28 bp, Artificial Sequence
  Isolated Molecule
acaggagaccaaagttcaactgaaacga

SEQ ID NO: 13 - DNA, 2208 bp, Artificial Sequence
  Isolated Molecule
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcggctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctgggacccggagatccagtacacttccaactattacaagtctaataatgttgaatttgctgttaatactgaaggtgtatatagtgaaccccgccccattggcaccagatacctgactcgtaatctg

SEQ ID NO: 14 - DNA, 2208 bp, Artificial Sequence
  Isolated Molecule
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccgcttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacgcccctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 15 - DNA, 2208 bp, Artificial Sequence
  Isolated Molecule
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcagcgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccgcgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 16 - DNA, 2208 bp, Artificial Sequence
  Isolated Molecule
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacacggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 17 - DNA, 2208 bp, Artificial Sequence
  Isolated Molecule
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcggctcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtagcaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggcagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagcacacttccaactattacaagtctaataatgttgaatttgctgttaatactgaaggtgtatatagtgaaccccgccccattggcaccagatacctgactcgtaatctg

SEQ ID NO: 18 - DNA, 2208 bp, Artificial Sequence
  Isolated Molecule
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaggctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaagccaaggaatacttccgggtatggtttggcaggacagagatgtgtacctgcaaggacccatttgggccaaaattcctcacacggacggcaactttcacccttctccgctgatgggagggtttggaatgaagcacccgcctccccagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 19 - DNA, 2205 bp, Artificial Sequence
  Isolated Molecule
atggctgccgatggttatcttccagattggctcgaggacaaccttagtgaaggaattcgcgagtggtgggctttgaaacctggagcccctcaacccaaggcaaatcaacaacatcaagacaacgcccgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctggaggtattttgacttcaacagattccactgccacttctcaccacgtgactggcagcgactcatcaacaactggggattccggcctaagcgactcaacttcaagctcttcaacattcaggtcaaagaggttacggacaacaatggagtcaagaccatcgccaataaccttaccagcacggtccaggccttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacgagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 20 - DNA, 2205 bp, Artificial Sequence
  Isolated Molecule
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggacaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccaattcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 21 - DNA, 2208 bp, Artificial Sequence
  Isolated Molecule
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagccatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcggctcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgacaaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 22 - DNA, 2208 bp, Artificial Sequence
  Isolated Molecule
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaatgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccagaccaaaaagaggcttcttgaacctcttggtctggttgaggaagcggctaagacggctcctggaaagaagaggcctgtagagcagtctcctcaggaaccgggctcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgcactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 23 - DNA, 2208 bp, Artificial Sequence
  Isolated Molecule
atggctgccgatggttattttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaatctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatctcccgtcgcaaatgctaagaacgggtaacaacttccagttcagctacgagtttgagaacgtacctttccatagcagctacgctcacagccaaagcctggaccgactaatgaatccactcatcgaccaatacttgcactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctgtggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 24 - DNA, 2208 bp, Artificial Sequence
  Isolated Molecule
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtccggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagcggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 25 - DNA, 2208 bp, Artificial Sequence
  Isolated Molecule
atggctgccgatggttatcttccagattggctcgaggacaaccttagtgaaggaattcgcgagtggtgggctttgaaacctggagcccctcaacccaaggcaaatcaacaacatcaagacaacgctcggggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtccggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcggcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 26 - DNA, 2208 bp, Artificial Sequence
  Isolated Molecule
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacctgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgcactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 27 - DNA, 2208 bp, Artificial Sequence
  Isolated Molecule
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaagaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgcactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 28 - DNA, 2208 bp, Artificial Sequence
  Isolated Molecule
  misc_feature (1325)..(1325): n is a, c, g, or t
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaccagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccnatacttgcactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccggatatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 29 - DNA, 2208 bp, Artificial Sequence
  Isolated Molecule
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgcactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagctacaaagaaggagaggacagtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagaccctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 30 - DNA, 2208 bp, Artificial Sequence
  Isolated Molecule
atggctgccgatggttatcttccagattggctcgaggacaaccttagtgaaggaattcgcgagtggtgggctttgaaacctggagcccctcaacccagggcaaatcaacaacatcaagacaacgctcgaggtcttgtgcttccgggttacaaataccttggacccggcaacggactcgacaagggggagccggtcaacgcagccgacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactgtcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaacgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcccatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 31 - DNA, 2208 bp, Artificial Sequence
  Isolated Molecule
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaagaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccacccatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatggtgaaccccgccccattggcaccagatacctgactcgtaatctg

SEQ ID NO: 32 - DNA, 2208 bp, Artificial Sequence
  Isolated Molecule
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgaccggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 33 - DNA, 2208 bp, Artificial Sequence
  Isolated Molecule
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcagccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcaattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccggcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaagaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 34 - DNA, 2208 bp, Artificial Sequence
  Isolated Molecule
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacagataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggtaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtatcggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccgtcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtggaccccgccccattggcaccagatacctgactcgtaatctg

SEQ ID NO: 35 - DNA, 2208 bp, Artificial Sequence
  Isolated Molecule
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 36 - DNA, 2208 bp, Artificial Sequence
  Isolated Molecule
atggctgccgatggttatcttccagattggctcgaggacaaccttagtgaaggaattcgcgagtggtgggctttgaaacctggagcccctcaacccaaggcaaatcaacaacgtcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggaggcaacccgtgcctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcagatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaaggccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattgacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatggatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacgggcggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 37 - DNA, 2208 bp, Artificial Sequence
  Isolated Molecule
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagcctaataatgttgaatttgctgttaatactgaaggtgtatatagtgaaccccgccccattggcaccagatacctgactcgtaatctg

SEQ ID NO: 38 - DNA, 2208 bp, Artificial Sequence
  Isolated Molecule
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacaacaaggcctacgaccagcagctcaaggccggagacaacccgtacctcaagtgcaaccacgccgacgccgagttccaggagcggctcaaagaagatacgtcttttgggggcaacctcgggcgagcagtcttccaggccaaaaagaggcctcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgagatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacctcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctactatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 39 - DNA, 2208 bp, Artificial Sequence
  Isolated Molecule
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgtgcacgacaaggcctacgaccagcagctcaaggccggagacaacccgtacctcaagtgcaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacctcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcacgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattgggccccgatacctgactcgtaatttt

SEQ ID NO: 40 - DNA, 2208 bp, Artificial Sequence
  Isolated Molecule
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacaacaaggcctacgaccagcagctcaaggccggagacaacccgtacctcaagtgcaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgagatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacctcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 41 - DNA, 2208 bp, Artificial Sequence
  Isolated Molecule
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtgcaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggcggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacctcggctacagcaccccctgggggtattttgacttcaacagattccactgccacttctcaccacgtgactggcagcgactcatcaacaacaactggggattccggcctaagcgactcaacttcgagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagtccagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgcctcaaccactgtgactcaaaacaacaacagcgaatttgcttggcctggagcttcttcttgggctctcaatggacgtaatagcttgatgaatcctggacctgctatggccagccacaaagaaggggaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 42 - DNA, 2208 bp, Artificial Sequence
  Isolated Molecule
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtgcaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagcccccccaggtgtgggatctcttacaatggcttcaggtggtggcgcaccagtggcggacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacctcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattagcggttctggacagaatcaacaaacgctaaaattcagtgtggccggacccagcaacatggctgtccagggaagaaactacatacctggacccagctaccgacaacaacgtgtctcaaccactgtgactcaaaacaacagcagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatactttcgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 43 - DNA, 2208 bp, Artificial Sequence
  Isolated Molecule
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtgcaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacctcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 44 - DNA, 2208 bp, Artificial Sequence
  Isolated Molecule
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtgcaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacctcgactacagcaccccctgggggtattttgacttcaacagattccactgccacttctcaccacgtgactggcagcggctcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcagggcagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 45 - DNA, 2208 bp, Artificial Sequence
  Isolated Molecule
atggctgccgatggttatcctccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggggacaacccgcacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcccgtagagcagtctcctcaggaaccggactcctccgcgggtattggcaaatcgggtgcacagcccgctaagaagagactcaatttcggtcagactggcgacactgagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggagtgaagcacccgcctcctcagatcctcatcaaaaacacacctgtacctgcggatcctccaacggccttcaacaaggacaggctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 46 - DNA, 2208 bp, Artificial Sequence
  Isolated Molecule
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcggacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagtttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggagtgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 47 - DNA, 2208 bp, Artificial Sequence
  Isolated Molecule
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacttacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcaccaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatatcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggagtgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 48 - DNA, 2208 bp, Artificial Sequence
  Isolated Molecule
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagtttagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttctggcaaacaaggaactggaagagacaacgtggatgcgaacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttgaaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 49 - DNA, 2208 bp, Artificial Sequence
  Isolated Molecule
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatagcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcgaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagcttttcaacattcgggtcaaagaggttacggacaacaatggagtcaagaccatcaccaataaccttaccagcacggtccaggtcttcacggactcagactatcagctcccgtacgtgcttgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcgaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggagtgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 50 - DNA, 2208 bp, Artificial Sequence
  Isolated Molecule
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggcgcacagcccgctaaaaagagactcaatttcggtcagactggcgacacagagccagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcgggcgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgcgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 51 - DNA, 2208 bp, Artificial Sequence
  Isolated Molecule
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgggttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagtccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggagctggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 52 - DNA, 2208 bp, Artificial Sequence
  Isolated Molecule
  misc_feature (377)..(377): n is a, c, g, or t
atggctgccgatggttatcttccagattggctcgaggacaaccttagtgaaggaattcgcgagaggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcntgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcggggaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcccggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggagtgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 53 - DNA, 2208 bp, Artificial Sequence
  Isolated Molecule
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacctcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 54 - DNA, 2208 bp, Artificial Sequence
  Isolated Molecule
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccagagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctggactctttcatcacccagtattctactggccaagtcagcgtggagatcgagtgggagctgcagaaggaaaacagcaagcgctggaacccggtgatccagtacacttccaactattacaagtctaataatgttgaatttgctgttaatactgaaggtgtatatagtgaaccccgccccattggcaccagatacctgactcgtaatctg

SEQ ID NO: 55 - DNA, 2208 bp, Artificial Sequence
  Isolated Molecule
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtggggcctactacaatggcttcaggcggtggcgcaccaatggcagacaataacgaaggcgtcgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgttacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagccacaaagcttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 56 - DNA, 2208 bp, Artificial Sequence
  Isolated Molecule
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagagacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcgttcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 57 - DNA, 2208 bp, Artificial Sequence
  Isolated Molecule
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacccgcggtataaccacgccgacgccgagtttcaggagcgtctgcaagaagatacgtcttttgggggcaacctcgggcgagcagtcttccaggccaagaagcgggttctcgaacctctcggtctggttggggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctcccatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 58 - DNA, 2208 bp, Artificial Sequence
  Isolated Molecule
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacgacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgcgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggcctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacggacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 59 - DNA, 2208 bp, Artificial Sequence
  Isolated Molecule
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcggctcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctcccatcgaccaatacctgtattacctgaacagaactcaaaatcagtccgggagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgactttactgtggacaacaatggactttatactgagcctcgccccattggcacccgttaccttacccgtcccctg

SEQ ID NO: 60 - DNA, 2208 bp, Artificial Sequence
  Isolated Molecule
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaagagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccgcaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctgtggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 61 - DNA, 2208 bp, Artificial Sequence
  Isolated Molecule
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcaactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcaccagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccgacgttgattttactgtggacaacaatggactttatactgagcctcgccccattggcacccgttaccttacccgtcccctg

SEQ ID NO: 62 - DNA, 2208 bp, Artificial Sequence
  Isolated Molecule
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaagagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccgcaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcctccgtacgtcctcggctctgcgcaccagggctgcctccctccgttcccggcggacgtgttcatgattccgcaatacggccacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgacgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 63 - DNA, 2208 bp, Artificial Sequence
  Isolated Molecule
atggctgccgatggttatcttccagattggctcgaggacaacctctctgagggcattcgcgagtggtgggacttgaaacctggagccccgaagcccaaagccaaccagcaagagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctacgggaacattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaccacgcctgttcctgcgaatcctccggcggagttttcagctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgattttactgtggacgacaatggactttatactgagcctcgccccattggcacccgttaccttacccgtcccctg

SEQ ID NO: 64 - DNA, 2208 bp, Artificial Sequence
  Isolated Molecule
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgctacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacgacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 65 - DNA, 2208 bp, Artificial Sequence
  Isolated Molecule
atggctgccgatggttatcttccagattggctcgaggacaacctctctgagggcattcgcgagtggtgggacttgaaacctggagctccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagcgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcgaaatctgccaacgttgattttactgtggacaacaatggactttatactgagcctcgccccgttggcacccgttaccttacccgtcccctg

SEQ ID NO: 66 - DNA, 2208 bp, Artificial Sequence
  Isolated Molecule
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccatacctgcggtataaccacgccgacgccgagtttcaggagcgtctgcaagaaaatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccactttccaccacgtgactggcagcgactcatcaacaacaattggggattccggcccaagagactcaacttcaaactcttcaacatccaagtcaaggaggtcacgtcgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggtccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 67 - DNA, 2208 bp, Artificial Sequence
  Isolated Molecule
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcacgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgggcctcgccccattggcacccgttaccttacccgtcccctg

SEQ ID NO: 68 - DNA, 2208 bp, Artificial Sequence
  Isolated Molecule
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgccccaggaaattggcattgcgactccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcacagctatggcctcacacaaagacgacgaagacaagttctttcccatgagcggtgtcatgatttttggaaaagagagcgccggagcttcaaacactgcattggacaatgtcatgattacaggcgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 69 - DNA, 2208 bp, Artificial Sequence
  Isolated Molecule
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacagactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaggaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcgccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcggccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatatagcctcaatgggcgtgaatccatcatcaaccctggcactgctatggcctcacacaaagacgacgaagacaagttctttcccatgggcggtgtcatgatttttggaaaagagagcgccggagcttcaaacactgcattggacaatgccatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 70 - DNA, 2208 bp, Artificial Sequence
  Isolated Molecule
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcggcagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactctaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggaacattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 71 - DNA, 2208 bp, Artificial Sequence
  Isolated Molecule
atggctgccgatggttatctcccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcagcgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaagagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgccaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 72 - DNA, 2208 bp, Artificial Sequence
  Isolated Molecule
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaaggggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 73 - DNA, 2208 bp, Artificial Sequence
  Isolated Molecule
atggctgccgatggttatcttccagattggctcgaggacaacctctctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgtttatgattccgcagtacggctacctaacgctcaacaatggcagccaggccgtgggacgttcatccttttactgcccggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacaaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcaacacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccttg

SEQ ID NO: 74 - DNA, 2208 bp, Artificial Sequence
  Isolated Molecule
atggctgccgatggttatcttccagattggctcgaggacaacctctctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctacaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgttcatgattccgcagtacggctacctaacgctcaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacaaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcgacacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccttg

SEQ ID NO: 75 - DNA, 2208 bp, Artificial Sequence
  Isolated Molecule
atggctgccgatggttatcttccagattggctcgaggacaacctctctgagggcattcgcgagtggtgggacttgaaacctggagccccgaaacctaaagccaaccagcaaaagcagggcgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccaacactcgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgttcatgattccgcagtacggctacctaacgctcaacaatggcagccaggccgtgggacgttcatccttttactgcctggaatatttcccttctcagatgctgagaacgggcaacaactttaccttcagctacacctttgaggaagtgcctttccacagcagttacgggcacagccagagcctggaccggctgatgaatcttctcatcgaccaatacctgtattacctgaacagaactcaaaatcagtccggaagtgcccaaaacaaggacttgctgtttagccgtgggtctccagctggcatgtttgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcagcacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccttg

SEQ ID NO: 76 - DNA, 2208 bp, Artificial Sequence
  Isolated Molecule
atggctgccgatggttatcttccagattggctcgaggacaacctctctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccaacacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgttcatgattccgcagtacggctacctaatgctcaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaatactgcattggacaatgtcatgatcacagatgaagaggaaattaaagccactaaccctgcggccaccgaaagatttgggaccgtggcagtcaatttccagagcagcagcacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccttg

SEQ ID NO: 77 - DNA, 2208 bp, Artificial Sequence
  Isolated Molecule
atggctgccgatggttatcttccagattggctcgaggacaacctctctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacgggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgttcatgattccgcagtacggctacctaacgctcaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtccgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcagcacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccttg

SEQ ID NO: 78 - DNA, 2208 bp, Artificial Sequence
  Isolated Molecule
  misc_feature (305)..(305): n is a, c, g, or t
atggctgccgatggttatcttccagattggctcgaggacaacctctctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggngcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcggcagagtcatcaccaccagcacccgcacctgggccttgcccacctacaataaccacctctacaagcaaatctccagtgcttcaacgggggccagcaacgacaaccactacttcggccacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgtccccggcggacgtgttcatgattccgcagtacggctacctaacactcaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacaaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcaacacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccttg

SEQ ID NO: 79 - DNA, 2208 bp, Artificial Sequence
  Isolated Molecule
atggctgccgatggttattttccagattggctcgaggacaacctttctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaggacaggccagcagcccgctaaaaagagactcaattttggtcagactggcgactcagagtcagtccccgacccacaacctctcggagaacctccagcgacccccgctgctgtgggacctactacaatggcttcaggcggtggcgcaccaatggcagacaataacgaaggtgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgttcatgattccgcagtacggctacctaacgctcaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcagcccagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatagtgagcctcgccccattggcacccgttaccttacccgtcccttg

SEQ ID NO: 80 - DNA, 2208 bp, Artificial Sequence
  Isolated Molecule
atggctgccgatggttatcttccagattggctcgaggacaacctctctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaacctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgttcatgattccgcagtacggctacctaacgctcaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagactacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcagcacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccttg

SEQ ID NO: 81 - DNA, 2208 bp, Artificial Sequence
  Isolated Molecule
atggctgccgatggttatcctccagattggctcgaggacaacctctctgagggcattcgcgagtggtgggacttgaaacctggagtcccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgttcatgattccgcagtacggctacctaacgctcaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcagcacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccttg

SEQ ID NO: 82 - DNA, 2196 bp, Artificial Sequence
  Isolated Molecule
atggctgccgatggttatcttccagattggctcgaggacaacctctctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagccttctcggattcagagtaccaactgccgtacgtcctcggctctgcgcaccagggctgcctccctccgttcccggcggacgtgttcatgattccgcagtacggctacctaacgctcaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgacccatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcagcacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttacctt

SEQ ID NO: 83 - DNA, 2208 bp, Artificial Sequence
  Isolated Molecule
atggctgccgatggttatcttccagattggctcgaggacaacctctctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgttcatgattccgcagtacggctacctaacgctcaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcagcacagaccccgcgaccggagatgtgcatgttatgggagccttacctggcatggtgtggcaagacagagacgtatacctgcagggtcccatttgggccaaaattcctcacacggatggacactctcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccttg

SEQ ID NO: 84 - DNA, 2208 bp, Artificial Sequence
  Isolated Molecule
atggctgccgatggttatcttccagattggctcgaggacaacctctctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgttcatgattccgcagtacggctacctaacgctcaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgacctatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggaacttcaaatactgcattggacaatgtcatgatcacagatgaagaggaaattaaagccactaaccctgtggccaccgaaagatttgggaccgtggcagtcaatttccagagcagcagcacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccttg

SEQ ID NO: 85 - DNA, 2208 bp, Artificial Sequence
  Isolated Molecule
atggctgccgatggttatcttccagattggctcgaggacagcctctctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacgatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgttcatgattccgcagtacggctacctaacgcccaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaataccagtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcagcacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccttg

SEQ ID NO: 86 - DNA, 2205 bp, Artificial Sequence
  Isolated Molecule
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcgggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctg

SEQ ID NO: 87 - protein, 736 aa, Artificial Sequence
  Isolated Molecule
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFGYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWDPEIQYTSNYYKSNNVEFAVNTEGVYSEPRPIGTRYLTRNL

SEQ ID NO: 88 - protein, 736 aa, Artificial Sequence
  Isolated Molecule
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCRFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNAPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 89 - protein, 736 aa, Artificial Sequence
  Isolated Molecule
MAADGYLPDWLEDNLSEGIREWWALKPGAPQPKANQQHQDNARGLVLPGYKYLGPGNGLDKGEPVSAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 90 - protein, 736 aa, Artificial Sequence
  Isolated Molecule
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNTAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 91 - protein, 736 aa, Artificial Sequence
  Isolated Molecule
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGSNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPAATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQHTSNYYKSNNVEFAVNTEGVYSEPRPIGTRYLTRNL

SEQ ID NO: 92 - protein, 736 aa, Artificial Sequence
  Isolated Molecule
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFRLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQSQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 93 - protein, 735 aa, Artificial Sequence
  Isolated Molecule
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWRYFDFNRFHCHFSPRDWQRLINNWGFRPKRLNFKLFNIQVKEVTDNNGVKTIANNLTSTVQAFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDELNSFITQYSTGQVSVEIEWELQKENSKRWNPEIQYTSNYYKSNNVEFAVNTEGVYSEPRPIGTRYLTRNL

SEQ ID NO: 94 - protein, 735 aa, Artificial Sequence
  Isolated Molecule
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQDKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 95 - protein, 736 aa, Artificial Sequence
  Isolated Molecule
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRAITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMTTNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 96 - protein, 736 aa, Artificial Sequence
  Isolated Molecule
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQTKKRLLEPLGLVEEAAKTAPGKKRPVEQSPQEPGSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLHYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 97 - protein, 736 aa, Artificial Sequence
  Isolated Molecule
MAADGYFPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGESPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYLPSQMLRTGNNFQFSYEFENVPFHSSYAHSQSLDRLMNPLIDQYLHYLSKTINGSGQNQQTLKFSVAGPSNMAVQGRNYIPGPSYRQQRVSTTVTQNNNSEFAWPGASSWALNGRNSLMNPGPAVASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 98 - protein, 736 aa, Artificial Sequence
  Isolated Molecule
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGPVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQAATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 99 - protein, 736 aa, Artificial Sequence
  Isolated Molecule
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGPVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWRRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 100 - protein, 736 aa, Artificial Sequence
  Isolated Molecule
MAADGYLPDWLEDNLSEGIREWWALKPGAPQPKANQQHQDNARGLVLPGYKYLGPGNGLDKGEPVNAADAAALEHDKAYDQQLKAGDNLYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLHYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 101 - protein, 736 aa, Artificial Sequence
  Isolated Molecule
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLHYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 102 - protein, 736 aa, Artificial Sequence
  Isolated Molecule
  misc_feature (442)..(442): Xaa can be any naturally occurring amino acid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISTSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDXYLHYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPDMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 103 - protein, 736 aa, Artificial Sequence
  Isolated Molecule
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLHYLSKTINGSGQNQQTLKFSVAGPSNMAVQGRNYIPGPSYRQQRVSTTVTQNNNSEFAWPGASSWALNGRNSLMNPGPAMASYKEGEDSFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQTLIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 104 - protein, 736 aa, Artificial Sequence
  Isolated Molecule
MAADGYLPDWLEDNLSEGIREWWALKPGAPQPRANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDCQLPYVLGSAHEGCLPPFPADVFMIPQYGYLTLNDGSQAVGRSSFYCLEYFPSQMLRTGNNFQFSYEFENVPFHSSYAHSQSLDRLTNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESHGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 105 - protein, 736 aa, Artificial Sequence
  Isolated Molecule
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPPIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYGEPRPIGTRYLTRNL

SEQ ID NO: 106 - protein, 736 aa, Artificial Sequence
  Isolated Molecule
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDRQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 107 - protein, 736 aa, Artificial Sequence
  Isolated Molecule
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCNSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPGNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 108 - protein, 736 aa, Artificial Sequence
  Isolated Molecule
MAADGYLPDWLEDNLSEGIREWWALKPGAPQPKANQQHQDNARGLVLPGYRYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTVANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSGPRPIGTRYLTRNL

SEQ ID NO: 109 - protein, 736 aa, Artificial Sequence
  Isolated Molecule
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 110 - protein, 736 aa, Artificial Sequence
  Isolated Molecule
MAADGYLPDWLEDNLSEGIREWWALKPGAPQPKANQQRQDNARGLVLPGYKYLGPGNGLDKGEPVNAADAAALEHDKAYDQQLKAGGNPCLKYNHADAEFQERLKEDTSFGGNLGRAVFQAKKRLLEPLGLVEEAAKTAPGKKRPVEQSPQEPDSSAGIGRSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKAIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTIDGSGQNQQTLKFSVAGPSNMAVQGRNYIPGPSYRQQRVSTTVTQNNNSEFAWPGASSWALNGRNSLMDPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTGGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 111 - protein, 736 aa, Artificial Sequence
  Isolated Molecule
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKPNNVEFAVNTEGVYSEPRPIGTRYLTRNL

SEQ ID NO: 112 - protein, 736 aa, Artificial Sequence
  Isolated Molecule
MAADGYLPDWLEDNLSEGIREWWALKPGAPQPKANQQHQDNARGLVLPGYKYLGPGNGLDKGEPVNAADAAALEHNKAYDQQLKAGDNPYLKCNHADAEFQERLKEDTSFGGNLGRAVFQAKKRPLEPLGLVEEAAKTAPGKKRPVEQSPQEPDSSAGIGKSGAQPAKKRLNFGQTGDTESVPDPQPIGEPPAAPSGVRSLTMASGGGAPVADNNEGADGVGSSSGNWHCDSQWLGDRVITTSTRTWALPTYNNHLYKQISNSTSGGSSNDNAYLGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPTMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 113 - protein, 736 aa, Artificial Sequence
  Isolated Molecule
MAADGYLPDWLEDNLSEGIREWWALKPGAPQPKANQQHQDNARGLVLPGYKYLGPGNGLDKGEPVNAADAAALVHDKAYDQQLKAGDNPYLKCNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYLGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFTIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGPRYLTRNF

SEQ ID NO: 114 - protein, 736 aa, Artificial Sequence
  Isolated Molecule
MAADGYLPDWLEDNLSEGIREWWALKPGAPQPKANQQHQDNARGLVLPGYKYLGPGNGLDKGEPVNAADAAALEHNKAYDQQLKAGDNPYLKCNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVRSLTMASGGGAPVADNNEGADGVGSSSGNWHCDSQWLGDRVITTSTRTWALPTYNNHLYKQISNSTSGGSSNDNAYLGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 115 - protein, 736 aa, Artificial Sequence
  Isolated Molecule
MAADGYLPDWLEDNLSEGIREWWALKPGAPQPKANQQHQDNARGLVLPGYKYLGPGNGLDKGEPVNAADAAALEHDKAYDQQLKAGDNPYLKCNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYLGYSTPWGYFDFNRFHCHFSPRDWQRLINNNWGFRPKRLNFELFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQSSYEFENVPFHSSYAHSQSLDRLMNPLIDQYLYYLSKTINGSGQNQQTLKFSVAGPSNMAVQGRNYIPGPSYRQQRASTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 116 - protein, 736 aa, Artificial Sequence
  Isolated Molecule
MAADGYLPDWLEDNLSEGIREWWALKPGAPQPKANQQHQDNARGLVLPGYKYLGPGNGLDKGEPVNAADAAALEHDKAYDQQLKAGDNPYLKCNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPPGVGSLTMASGGGAPVADNNEGADGVGSSSGNWHCDSQWLGDRVITTSTRTWALPTYNNHLYKQISNSTSGGSSNDNAYLGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTISGSGQNQQTLKFSVAGPSNMAVQGRNYIPGPSYRQQRVSTTVTQNNSSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILSGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 117 - protein, 736 aa, Artificial Sequence
  Isolated Molecule
MAADGYLPDWLEDNLSEGIREWWALKPGAPQPKANQQHQDNARGLVLPGYKYLGPGNGLDKGEPVNAADAAALEHDKAYDQQLKAGDNPYLKCNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYLGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 118 - protein, 736 aa, Artificial Sequence
  Isolated Molecule
MAADGYLPDWLEDNLSEGIREWWALKPGAPQPKANQQHQDNARGLVLPGYKYLGPGNGLDKGEPVNAADAAALEHDKAYDQQLKAGDNPYLKCNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYLDYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQGRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 119 - protein, 736 aa, Artificial Sequence
  Isolated Molecule
MAADGYPPDWLEDNLSEGIREWWALKPGAPQPKANQQHQDNARGLVLPGYKYLGPGNGLDKGEPVNAADAAALEHDKAYDQQLKAGDNPHLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGVKHPPPQILIKNTPVPADPPTAFNKDRLNSFITQYSTGQVSVEIEWELQKENSKRWNPEIQYTSNYYKSNNVEFAVNTEGVYSEPRPIGTRYLTRNL

SEQ ID NO: 120 - protein, 736 aa, Artificial Sequence
  Isolated Molecule
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGVKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 121 - protein, 736 aa, Artificial Sequence
  Isolated Molecule
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLTNNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYIPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGVKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 122 - protein, 736 aa, Artificial Sequence
  Isolated Molecule
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLISGKQGTGRDNVDANKVMITNEEEIKTTNPVATESYGQVATNHQSAQAQAQTGWVQNQGILPGMVWQDRDVYLQGPIWAKIPHTDGNFHPSPLMGGFEMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 123 - protein, 736 aa, Artificial Sequence
  Isolated Molecule
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTIASGGGAPVADNNEGADGVGSSSGNWHCDSQWLGDRVITTSTRTWALPTYNNHLYKRISNSTSGGSSNDNAYFGYSTPWGYFDFNRFHCHFSPRDWQRLINNNWGFRPKRLNFKLFNIRVKEVTDNNGVKTITNNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTRNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGVKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 124 - protein, 736 aa, Artificial Sequence
  Isolated Molecule
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTEPVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPAGVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTATQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 125 - protein, 736 aa, Artificial Sequence
  Isolated Molecule
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAGFQERLKEDTSFGGNLGRAVFQAKKRLLEPLGLVEEAAKTAPGKKRPVEQSPQEPDSSAGIGKSGAQPAKKRLNFGQTGDTESVPVPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGAGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 126 - protein, 736 aa, Artificial Sequence
  Isolated Molecule
  misc_feature (126)..(126): Xaa can be any naturally occurring amino acid
MAADGYLPDWLEDNLSEGIRERWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLXEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSPDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGVKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 127 - protein, 736 aa, Artificial Sequence
  Isolated Molecule
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYLGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 128 - protein, 736 aa, Artificial Sequence
  Isolated Molecule
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLDSFITQYSTGQVSVEIEWELQKENSKRWNPVIQYTSNYYKSNNVEFAVNTEGVYSEPRPIGTRYLTRNL

SEQ ID NO: 129 - protein, 736 aa, Artificial Sequence
  Isolated Molecule
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGVDGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKLASFITQYSTGQVSVEIEWELQKENSKRWNPEVQYTSNYAKSANVDFTVDNNGLYTEPRPIGTRYLTRPL

SEQ ID NO: 130 - protein, 736 aa, Artificial Sequence
  Isolated Molecule
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKRRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 131 - protein, 736 aa, Artificial Sequence
  Isolated Molecule
MAADGYLPDWLEDNLSEGIREWWDLKPGAPKPKANQQKQDDGRGLVLPGYKYLGPFNGLDKGEPVNAADAAALEHDKAYDQQLKAGDNPYPRYNHADAEFQERLQEDTSFGGNLGRAVFQAKKRVLEPLGLVGEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPPIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 132 - protein, 736 aa, Artificial Sequence
  Isolated Molecule
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPRPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGPPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 133 - protein, 736 aa, Artificial Sequence
  Isolated Molecule
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGGSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPPIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 134 - protein, 736 aa, Artificial Sequence
  Isolated Molecule
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAVASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 135 - protein, 736 aa, Artificial Sequence
  Isolated Molecule
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQQLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSTSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSADVDFTVDNNGLYTEPRPIGTRYLTRPL

SEQ ID NO: 136 - protein, 736 aa, Artificial Sequence
  Isolated Molecule
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQPPYVLGSAHQGCLPPFPADVFMIPQYGHLTLNNGSQAVGRSSFYCLEYFPSQMLRTGNNFTFSYTFEEVPFHSSYAHSQSLDRLTNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 137 - protein, 736 aa, Artificial Sequence
  Isolated Molecule
MAADGYLPDWLEDNLSEGIREWWDLKPGAPKPKANQQEQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHATGTLPGMVWQDRDVYLQGPIWAKIPHTDGHFHPSPLMGGFGLKNPPPQILIKTTPVPANPPAEFSATKFASFITQYSTGQVSVEIEWELQKENSKRWNPEVQYTSNYAKSANVDFTVDDNGLYTEPRPIGTRYLTRPL

SEQ ID NO: 138 - protein, 736 aa, Artificial Sequence
  Isolated Molecule
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSLQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNDNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 139 - protein, 736 aa, Artificial Sequence
  Isolated Molecule
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEAPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPVGTRYLTRPL

SEQ ID NO: 140 - protein, 736 aa, Artificial Sequence
  Isolated Molecule
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQENTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFPPRDWQRLINNNWGFRPKRLNFKLFNIQVKEVTSNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 141 - protein, 736 aa, Artificial Sequence
  Isolated Molecule
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGTSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTGPRPIGTRYLTRPL

SEQ ID NO: 142 - protein, 736 aa, Artificial Sequence
  Isolated Molecule
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNAPGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITGEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 143 - protein, 736 aa, Artificial Sequence
  Isolated Molecule
MAADGYLPDWLEDNLSEGIREWWDLKPGAPKPKANQQKQDDGRGLVLPGYKYLGPFNRLDKGEPVNAADAAALEHDKAYDQQLKAGDNPYLRYNHADAEFQERLQEDTSFGGNLGRAVFQAKKRVLEPLGLVEEGAKTAPGRKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGGQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYSLNGRESIINPGTAMASHKDDEDKFFPMGGVMIFGKESAGASNTALDNAMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 144 - protein, 736 aa, Artificial Sequence
  Isolated Molecule
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGGRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNSTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGTLPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 145 - protein, 736 aa, Artificial Sequence
  Isolated Molecule
MAADGYLPDWLEDNLSEGIREWWDLKPGAPKPKANQQKQDDGRGLVLPGYKYLGPFNGLDKGEPVSAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKERLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 146 - protein, 736 aa, Artificial Sequence
  Isolated Molecule
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEGEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 147 - protein, 736 aa, Artificial Sequence
  Isolated Molecule
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCPEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSNTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 148 - protein, 736 aa, Artificial Sequence
  Isolated Molecule
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSDTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 149 - protein, 736 aa, Artificial Sequence
  Isolated Molecule
MAADGYLPDWLEDNLSEGIREWWDLKPGAPKPKANQQKQGDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTNTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYGHSQSLDRLMNLLIDQYLYYLNRTQNQSGSAQNKDLLFSRGSPAGMFVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 150 - protein, 736 aa, Artificial Sequence
  Isolated Molecule
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTNTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLMLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPAATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 151 - protein, 736 aa, Artificial Sequence
  Isolated Molecule
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 152 - protein, 736 aa, Artificial Sequence
  Isolated Molecule
  misc_feature (102)..(102): Xaa can be any naturally occurring amino acid
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQXRLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGGRVITTSTRTWALPTYNNHLYKQISSASTGASNDNHYFGHSTPWGYFDFNRFHCHFSPRDWQRLINNNWGFRPKRLNFKLFNIQVKEVTTNDGVTTIANNLTSTVQVFSDSEYQLPYVLGSAHQGCLPPSPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSNTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 153 - protein, 736 aa, Artificial Sequence
  Isolated Molecule
MAADGYFPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGRTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSPDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYSEPRPIGTRYLTRPL

SEQ ID NO: 154 - protein, 736 aa, Artificial Sequence
  Isolated Molecule
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQTSSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDYNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 155 - protein, 736 aa, Artificial Sequence
  Isolated Molecule
MAADGYPPDWLEDNLSEGIREWWDLKPGVPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 156 - protein, 732 aa, Artificial Sequence
  Isolated Molecule
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQAFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDPYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYL

SEQ ID NO: 157 - protein, 736 aa, Artificial Sequence
  Isolated Molecule
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHSHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 158 - protein, 736 aa, Artificial Sequence
  Isolated Molecule
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDLYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGTSNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 159 - protein, 736 aa, Artificial Sequence
  Isolated Molecule
MAADGYLPDWLEDSLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTPNNGSQAVGRSSFYCLEYFPSQMLRTGNNFTFSYTFEEVPFHSSYAHSQSLDRLMNPLIDQYQYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 160 - protein, 735 aa, Artificial Sequence
  Isolated Molecule
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSRAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 161 - DNA, 2209 bp, Artificial Sequence
  Isolated Molecule
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaagaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgcactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaattttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 162 - DNA, 2207 bp, Artificial Sequence
  Isolated Molecule
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgtgcacgacaaggcctacgaccagcagctcaggccggagacaacccgtacctcaagtgcaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacctcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcacgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattgggccccgatacctgactcgtaatttt

SEQ ID NO: 163 - DNA, 2208 bp, Artificial Sequence
  Isolated Molecule
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtgcaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacctcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactattagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 164 - DNA, 2207 bp, Artificial Sequence
  Isolated Molecule
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcggacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagtttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggagtgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 165 - DNA, 2207 bp, Artificial Sequence
  Isolated Molecule
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatagcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcgaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagcttttcaacattcgggtcaaagaggttacggacaacaatggagtcaagaccatcaccaataaccttaccagcacggtccaggtcttcacggactcagactatcagctcccgtacgtgcttgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcgaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctggttcaaaaccaaggaatacttccgggtatggtttggcaggacagagatgtgtacctgcaaggacccatttgggccaaaattcctcacacggacggcaactttcacccttctccgctgatgggagggtttggagtgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 166 - DNA, 2208 bp, Artificial Sequence
  Isolated Molecule
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggcgcacagcccgctaaaaagagactcaatttcggtcagactggcgacacagagccagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcgggcgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgcgactcaaaacaacaacagcgaatttgcttggcctggagcttcttcttgagctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 167 - DNA, 2208 bp, Artificial Sequence
  Isolated Molecule
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcaactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcaccagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacctaatactccacaggacaagtgagtgtggaaattgaatgggagctgcagaaagaaaacagcaagcgctggaatcccgaagtgcagtacacatccaattatgcaaaatctgccgacgttgattttactgtggacaacaatggactttatactgagcctcgccccattggcacccgttaccttacccgtcccctg

SEQ ID NO: 168 - DNA, 2208 bp, Artificial Sequence
  Isolated Molecule
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccatacctgcggtataaccacgccgacgccgagtttcaggagcgtctgcaagaaaatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccactttccaccacgtgactggcagcgactcatcaacaacaattggggattccggcccaagagactcaacttcaaactcttcaacatccaagtcaaggaggtcacgtcgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggtccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactctagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 169 - DNA, 2207 bp, Artificial Sequence
  Isolated Molecule
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacagactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaggaaacgtccggtagagcagtcgccacaagagccagactcctcctcgggcatcggcaagacaggccagcagcccgctaaaaagagactcaattttggtcagactggcgactcagagtcagccccgatccacaacctctcggagaacctccagcaacccccgctgctgtgggacctactacaatggcttcaggcggtggcgcgccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcggccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatatagcctcaatgggcgtgaatccatcatcaaccctggcactgctatggcctcacacaaagacgacgaagacaagttctttcccatgggcggtgtcatgatttttggaaaagagagcgccggagcttcaaacactgcattggacaatgccatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 170 - DNA, 2211 bp, Artificial Sequence
  Isolated Molecule
  misc_feature (2191)..(2191): n is a, c, g, or t
  misc_feature (2203)..(2203): n is a, c, g, or t
atggctgccgatggttatcttccagattggctcgaggacaacctctctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaacctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgttcatgattccgcagtacggctacctaacgctcaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagactacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcagcacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggacttttatactgagcctcgccccattggcacccgnttaccttacccngtcccttg

SEQ ID NO: 171 - protein, 736 aa, Artificial Sequence
  Isolated Molecule
MAADGYLPDWLEDNLSEGIREWWALKPGAPQPKANQQHQDNARGLVLPDYKYLGPGNGLDKGEPVNAADVAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDGVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLHYLPKTINGSGQNQQTLKFSVAGPSNMAVQGRNYIPGPSYRQQRVSTTVTQNNNSEFAWPGASSWALNGRNSLMNPGPAMASYKEGEDSFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQTLIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 172 - protein, 736 aa, Artificial Sequence
  Isolated Molecule
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKRRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQIKEVTDNNGVKTIANNLTSTVQVFTDLDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLHYLSKTINGSGQNQQTLKFSVAGPSNMAVQGRNYIPGPSYRQQRVSTTVTQNNNSEFAWPGASSWALNGRNSLMNPGPAMASYKEGEDSFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQTLIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 173 - protein, 736 aa, Artificial Sequence
  Isolated Molecule
MAADGYLPDWLEDNLSEGIREWWALKPGAPQPKANQQHQDNARGLVLPGYKYLGPGNGLDKGEPVSAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVSDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPSPADVFMIPQYGYLTLNDGSQAVGRSSFYCLEYFPSQMLRTGNNFQFSYEFENVPFHSSYAHSQSLDRLMNPLIDQYLHYLSKTINGSGQNQQTLKFSVAGPSNMAVQGRNYIPGPSYRQQRVSTTVTQNNNSEFAWPGASSWALNGRNSLMNPGPAMASYKEGEDSFFPLSGSLIFGKQGTGRDDVDADKVIITNEEEIKTTNPVATESYGQVATNHQSAQAQAQTGWVQNQGILPGMVWQDRDVYLQGPIWAKIPHTDGNFHPSPLMGGFGMKHPPPQTLIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 174 - protein, 736 aa, Artificial Sequence
  Isolated Molecule
MAADGYLPDWLEDNLSEGIREWWALKPGAPQPKANQQHQDNARGLVLPGYKYLGPGNGLDKGEPVNAADAAALEHDKAYDQQLKAGDNPYLKYNHAGAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGAGGVGSSSGNWHCDSQWLGDRVVTTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHGGCLPPFPADVFMIPQYGYLTLNDGSQAVGRSSFYCLEYFPSQMLRTGNNFQFSYEFENVPFHSSYAHSQSLDRLMNPLIDQYLHYLSKTINGSGQNQQTLKFSVAGPSNMAVQGRSYIPGPSYRQQRVSTTVTQNNNSEFAWPGASSWALNGRNSLMNPGPAMASYKEGEDSFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQTLIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 175 - protein, 736 aa, Artificial Sequence
  Isolated Molecule
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVVTTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSHAHSQSLDRLMNPLIDQYLHYLSKTINGSGQNQQTLKFSVAGHSNMAVQGRNYIPGPSYRQQRVSTTVTQNNNSEFAWPGASSWALNGRNSLMNPGPAMASYKEGEDSFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQTLIKNTPVPADPPTAFNKDKLNSFITQYSTGQVSVEIGWELQKENSKRWNPEIQYTSNYYKSNNVEFAVNTEGVYSEPRPIGTRYLTRNL

SEQ ID NO: 176 - protein, 736 aa, Artificial Sequence
  Isolated Molecule
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNRLYKQISNSTSGGSSNDNAYFGYSTPWGYFDFNRFHCHFSPRDWQRLINNNWGFRPKRLNFKPFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLHYLSKTINGSGQNQQTLKFSVAGPSNMAVQGRNYIPGPSYRQQRVSTTVTQNNNSEFAWPGASSWALNGRNSLMNPGPAMASYKEGEDSFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQTLIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 177 - protein, 736 aa, Artificial Sequence; identical to SEQ ID NO: 103
  Isolated Molecule

SEQ ID NO: 178 - protein, 736 aa, Artificial Sequence; identical to SEQ ID NO: 103
  Isolated Molecule

SEQ ID NO: 179 - protein, 736 aa, Artificial Sequence
  Isolated Molecule
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 180 - protein, 736 aa, Artificial Sequence; identical to SEQ ID NO: 109
  Isolated Molecule

SEQ ID NO: 181 - protein, 736 aa, Artificial Sequence
  Isolated Molecule
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKSGQQPAKKRLNFGQTGDSESVPDPQPLGEPPATPAALGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSKAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 182 - protein, 736 aa, Artificial Sequence
  Isolated Molecule
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 183 - protein, 736 aa, Artificial Sequence
  Isolated Molecule
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSTSTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAVASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 184 - protein, 736 aa, Artificial Sequence
  Isolated Molecule
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 185 - protein, 735 aa, Artificial Sequence [sequence omitted]

SEQ ID NO: 186 - protein, 15 aa, Artificial Sequence
  Isolated Molecule
PADVFMVPQYGYLTL

SEQ ID NO: 187 - protein, 16 aa, Artificial Sequence
  Isolated Molecule
PADVFMIPQYGYLTLN

SEQ ID NO: 188 - protein, 16 aa, Artificial Sequence
  Isolated Molecule
PADVFMVPQYGYLTLN

SEQ ID NO: 189 - protein, 16 aa, Artificial Sequence
  Isolated Molecule
PNDVFMVPQYGYCGLV

SEQ ID NO: 190 - protein, 16 aa, Artificial Sequence
  Isolated Molecule
PPQVFTLPQYGYATLN

SEQ ID NO: 191 - protein, 16 aa, Artificial Sequence
  Isolated Molecule
PADVFTIPQYGYLTLN

SEQ ID NO: 192 - protein, 15 aa, Artificial Sequence
  Isolated Molecule
GNNFTFSYTFEDVPF

SEQ ID NO: 193 - protein, 16 aa, Artificial Sequence
  Isolated Molecule
GNNFTFSYTFEEVPFH

SEQ ID NO: 194 - protein, 16 aa, Artificial Sequence
  Isolated Molecule
GNNFTFSYTFEDVPFH

SEQ ID NO: 195 - protein, 16 aa, Artificial Sequence
  Isolated Molecule
GNNFQFSYTFEDVPFH

SEQ ID NO: 196 - protein, 16 aa, Artificial Sequence
  Isolated Molecule
GNNFEITYSFEKVPFH

SEQ ID NO: 197 - protein, 16 aa, Artificial Sequence
  Isolated Molecule
GNNFEFTYNFEEVPFH

SEQ ID NO: 198 - protein, 16 aa, Artificial Sequence
  Isolated Molecule
GNNFEFSYSFEDVPFH

SEQ ID NO: 199 - protein, 16 aa, Artificial Sequence
  Isolated Molecule
GNNFQFTYTFEDVPFH

SEQ ID NO: 200 - protein, 16 aa, Artificial Sequence
  Isolated Molecule
GNNFQFSYEFENVPFH

SEQ ID NO: 201 - protein, 16 aa, Artificial Sequence
  Isolated Molecule
GNNFQSSYEFENVPFH

SEQ ID NO: 202 - protein, 9 aa, Artificial Sequence
  Isolated Molecule
SADNNNSEY

SEQ ID NO: 203 - protein, 10 aa, Artificial Sequence
  Isolated Molecule
KTDNNNSNFT

SEQ ID NO: 204 - protein, 10 aa, Artificial Sequence
  Isolated Molecule
SADNNNSEYS

SEQ ID NO: 205 - protein, 10 aa, Artificial Sequence
  Isolated Molecule
ANDNNNSNFP

SEQ ID NO: 206 - protein, 15 aa, Artificial Sequence
  Isolated Molecule
ANQNYKIPATGSDSI

SEQ ID NO: 207 - protein, 10 aa, Artificial Sequence
  Isolated Molecule
SGVNRASVSA

SEQ ID NO: 208 - protein, 10 aa, Artificial Sequence
  Isolated Molecule
LDQNNNSNFA

SEQ ID NO: 209 - protein, 10 aa, Artificial Sequence
  Isolated Molecule
TGQNNNSNFA

SEQ ID NO: 210 - protein, 10 aa, Artificial Sequence
  Isolated Molecule
VTQNNNSEFA

SEQ ID NO: 211 - protein, 10 aa, Artificial Sequence
  Isolated Molecule
VTQNNSSEFA

SEQ ID NO: 212 - protein, 10 aa, Artificial Sequence
  Isolated Molecule
VTRNNNSEFA

SEQ ID NO: 213 - DNA, 25 bp, Artificial Sequence
  Isolated Molecule
gactgtgtttctgagcaataaatga

SEQ ID NO: 214 - DNA, 31 bp, Artificial Sequence
  Isolated Molecule
gatgactgtgtttctgagcaataaatgactt

SEQ ID NO: 215 - DNA, 31 bp, Artificial Sequence
  Isolated Molecule
gatgactgcatctttgaacaataaatgattt

SEQ ID NO: 216 - DNA, 31 bp, Artificial Sequence
  Isolated Molecule
gatgactgtgacatggaacaataaatgactc

SEQ ID NO: 217 - DNA, 31 bp, Artificial Sequence
  Isolated Molecule
gacgactgcgtttctgagcaataaatgactt

SEQ ID NO: 218 - DNA, 28 bp, Artificial Sequence
  Isolated Molecule
tcgtttcagttgaactttggtctcctgt

SEQ ID NO: 219 - DNA, 33 bp, Artificial Sequence
  Isolated Molecule
tgattcgtttcagttgaactttggtctcctgtc

SEQ ID NO: 220 - DNA, 32 bp, Artificial Sequence
  Isolated Molecule
taattcgtttcagttgaactttggtctctgcg

SEQ ID NO: 221 - DNA, 34 bp, Artificial Sequence
  Isolated Molecule
taattcgtttcagttgaactttggctcttgtgca

SEQ ID NO: 222 - DNA, 32 bp, Artificial Sequence
  Isolated Molecule
ttattcgtttcagttgaactttggtctccgtg

SEQ ID NO: 223 - DNA, 33 bp, Artificial Sequence
  Isolated Molecule
taattcgtgtcagttgaactttggtctcatgtc

SEQ ID NO: 224 - DNA, 33 bp, Artificial Sequence
  Isolated Molecule
tgattcgtttcagttgaactttggtctcctgtg

SEQ ID NO: 225 - DNA, 32 bp, Artificial Sequence
  Isolated Molecule
tgattcgtttcagttgaactttggtctctgcg

SEQ ID NO: 226 - DNA, 22 bp, Artificial Sequence
  Isolated Molecule
ccatcgacgtcagacgcggaag

SEQ ID NO: 227 - DNA, 70 bp, Artificial Sequence
  Isolated Molecule
agcgggcctgcccctcagtcgcggatccatcgacgtcagacgcggaaggagctccggtggactttgccga

SEQ ID NO: 228 - DNA, 67 bp, Artificial Sequence
  Isolated Molecule
aacgggtgcgcgagtcagttgcgcagccatcgacgtcagacgcggaagcttcgatcaactacgcaga

SEQ ID NO: 229 - DNA, 67 bp, Artificial Sequence
  Isolated Molecule
aacgggagtgcacgtcacttgcgcagccgacaacgtcagacgcggaagcaccggcggactacgcgga

SEQ ID NO: 230 - DNA, 67 bp, Artificial Sequence
  Isolated Molecule
agcgggcctgtccgtcagttgcgcagccatcgacgtcagacgcggaagctccggtggactacgcgga

SEQ ID NO: 231 - DNA, 70 bp, Artificial Sequence
  Isolated Molecule
ctgggtgacgtcaccaatactagctataaaagtctggagaagcgggccaggctctcatttgttcccgaga

SEQ ID NO: 232 - DNA, 67 bp, Artificial Sequence
  Isolated Molecule
agcgggcctgcccctcagttgcggagccatcgacgtcagacgcggaagcaccggtggactttgcgga

SEQ ID NO: 233 - DNA, 24 bp, Artificial Sequence
  Isolated Molecule
gccgacaggtaccaaaacaaatgt

SEQ ID NO: 234 - DNA, 73 bp, Artificial Sequence
  Isolated Molecule
gacgcggaaggagctccggtggactttgccgacaggtaccaaaacaaatgttctcgtcacgcgggcatgcttc

SEQ ID NO: 235 - DNA, 70 bp, Artificial Sequence
  Isolated Molecule
gacgcggaagcttcgatcaactacgcagacaggtaccaaaacaaatgttctcgtcacgtgggcatgaatc

SEQ ID NO: 236 - DNA, 70 bp, Artificial Sequence
  Isolated Molecule
gacgcggaagcaccggcggactacgcggacaggtaccaaaacaaatgttctcgtcacgtgggcatgaatc

SEQ ID NO: 237 - DNA, 70 bp, Artificial Sequence
  Isolated Molecule
gacgcggaagctccggtggactacgcggacaggtaccaaaacaaatgttctcgtcacgtgggtatgaatc

SEQ ID NO: 238 - DNA, 63 bp, Artificial Sequence
  Isolated Molecule
gaagcgggccaggctctcatttgttcccgagacgcctcgcagttcagacgtgactgttgatcc

SEQ ID NO: 239 - DNA, 73 bp, Artificial Sequence
  Isolated Molecule
gacgcggaaggagctccggtggactttgccgacaggtaccaaaacaaatgttctcgtcacgcgggcatgattc

SEQ ID NO: 240 - DNA, 22 bp, Artificial Sequence
  Isolated Molecule
ccggcgtgtcagaatctcaacc

SEQ ID NO: 241 - DNA, 66 bp, Artificial Sequence
  Isolated Molecule
cgggacgagagactgttcagagtgcttccccggcgtgtcagaatctcaaccggtcgtcagaaagag

SEQ ID NO: 242 - DNA, 66 bp, Artificial Sequence
  Isolated Molecule
cggacagaaagactgtttagagtgctttcccgtgtcagaatctcaacccgtttctgtcgtcaaaaa

SEQ ID NO: 243 - DNA, 72 bp, Artificial Sequence
  Isolated Molecule
tggtcaaagagactgtggggaatgcttccctggaatgtcagaatctcaacccgtttctgtcgtcaaaaagaa

SEQ ID NO: 244 - DNA, 69 bp, Artificial Sequence
  Isolated Molecule
cggggtcatggactgtgccgagtgcttccccgtgtcagaatctcaacccgtgtctgtcgtcagaaagcg

SEQ ID NO: 245 - DNA, 61 bp, Artificial Sequence
  Isolated Molecule
caatttgacaacatttctaacaaatgtgatgaatgtgaatatttgaatcggggcaaaaatg

SEQ ID NO: 246 - DNA, 66 bp, Artificial Sequence
  Isolated Molecule
cgggaccagagactgttcagaatgtttccccggcgtgtcagaatctcaaccggtcgtcagaaagag

SEQ ID NO: 247 - DNA, 66 bp, Artificial Sequence
  Isolated Molecule
cggggtcagagactgtttagagtgtttccccggcgtgtcagaatctcaaccggtcgtcagaaaaaa

SEQ ID NO: 248 - DNA, 66 bp, Artificial Sequence
  Isolated Molecule
cggggtcagagactgctcagagtgtttccccggcgtgtcagaatctcaaccggtcgtcagaaagag

SEQ ID NO: 249 - DNA, 66 bp, Artificial Sequence
  Isolated Molecule
cggggtcagagactgctcagagtgcttccccggcgcgtcagaatctcaacccgtcgtcagaaaaaa

What is claimed is:

1. An isolated adeno-associated virus (AAV) capsid protein comprising the amino acid sequence set forth as SEQ ID NO: 103, 129, 130, 131, 132, 133, 134, 135, 136, 137, 138, 139, 140, 141, 142, 143, 144, 145, 146, 147, 148, 149, 150, 171, 172, 173, 174, 175, 176, 177 or 178.

2. A composition comprising the isolated AAV capsid protein of claim 1.

3. A composition comprising the isolated AAV capsid protein of claim 1 and a pharmaceutically acceptable carrier.

4. A recombinant AAV (rAAV) comprising the isolated AAV capsid protein of claim 1.

5. A composition comprising the rAAV of claim 4.

6. The composition of claim 5 further comprising a pharmaceutically acceptable carrier.

7. A kit comprising:
a container housing a recombinant AAV having an isolated AAV capsid protein of claim 1.

8. The kit of claim 7, wherein the container is a syringe.

9. The rAAV of claim 4, wherein the AAV capsid protein comprises the amino acid sequence as set forth in SEQ ID NO: 103.

10. The rAAV of claim 4, wherein the AAV capsid protein comprises the amino acid sequence as set forth in SEQ ID NO: 129.

11. The rAAV of claim 4, wherein the AAV capsid protein comprises the amino acid sequence as set forth in SEQ ID NO: 130.

12. The rAAV of claim 4, wherein the AAV capsid protein comprises the amino acid sequence as set forth in SEQ ID NO: 131.

13. The rAAV of claim 4, wherein the AAV capsid protein comprises the amino acid sequence as set forth in SEQ ID NO: 132.

14. The rAAV of claim 4, wherein the AAV capsid protein comprises the amino acid sequence as set forth in SEQ ID NO: 133.

15. The rAAV of claim 4, wherein the AAV capsid protein comprises the amino acid sequence as set forth in SEQ ID NO: 134.

16. The rAAV of claim 4, wherein the AAV capsid protein comprises the amino acid sequence as set forth in SEQ ID NO: 135.

17. The rAAV of claim 4, wherein the AAV capsid protein comprises the amino acid sequence as set forth in SEQ ID NO: 136.

18. The rAAV of claim 4, wherein the AAV capsid protein comprises the amino acid sequence as set forth in SEQ ID NO: 137.

19. The rAAV of claim 4, wherein the AAV capsid protein comprises the amino acid sequence as set forth in SEQ ID NO: 138.

20. The rAAV of claim 4, wherein the AAV capsid protein comprises the amino acid sequence as set forth in SEQ ID NO: 139.

21. The rAAV of claim 4, wherein the AAV capsid protein comprises the amino acid sequence as set forth in SEQ ID NO: 140.

22. The rAAV of claim 4, wherein the AAV capsid protein comprises the amino acid sequence as set forth in SEQ ID NO: 141.

23. The rAAV of claim 4, wherein the AAV capsid protein comprises the amino acid sequence as set forth in SEQ ID NO: 142.

24. The rAAV of claim 4, wherein the AAV capsid protein comprises the amino acid sequence as set forth in SEQ ID NO: 143.

25. The rAAV of claim 4, wherein the AAV capsid protein comprises the amino acid sequence as set forth in SEQ ID NO: 144.

26. The rAAV of claim 4, wherein the AAV capsid protein comprises the amino acid sequence as set forth in SEQ ID NO: 145.

27. The rAAV of claim 4, wherein the AAV capsid protein comprises the amino acid sequence as set forth in SEQ ID NO: 146.

28. The rAAV of claim 4, wherein the AAV capsid protein comprises the amino acid sequence as set forth in SEQ ID NO: 147.

29. The rAAV of claim 4, wherein the AAV capsid protein comprises the amino acid sequence as set forth in SEQ ID NO: 148.

30. The rAAV of claim 4, wherein the AAV capsid protein comprises the amino acid sequence as set forth in SEQ ID NO: 149.

31. The rAAV of claim 4, wherein the AAV capsid protein comprises the amino acid sequence as set forth in SEQ ID NO: 150.

32. The rAAV of claim 4, wherein the AAV capsid protein comprises the amino acid sequence as set forth in SEQ ID NO: 171.

33. The rAAV of claim 4, wherein the AAV capsid protein comprises the amino acid sequence as set forth in SEQ ID NO: 172.

34. The rAAV of claim 4, wherein the AAV capsid protein comprises the amino acid sequence as set forth in SEQ ID NO: 173.

35. The rAAV of claim 4, wherein the AAV capsid protein comprises the amino acid sequence as set forth in SEQ ID NO: 174.

36. The rAAV of claim 4, wherein the AAV capsid protein comprises the amino acid sequence as set forth in SEQ ID NO: 175.

37. The rAAV of claim 4, wherein the AAV capsid protein comprises the amino acid sequence as set forth in SEQ ID NO: 176.

38. The rAAV of claim 4, wherein the AAV capsid protein comprises the amino acid sequence as set forth in SEQ ID NO: 177.

39. The rAAV of claim 4, wherein the AAV capsid protein comprises the amino acid sequence as set forth in SEQ ID NO: 178.

40. The rAAV of claim 4, wherein the AAV capsid protein comprises the amino acid sequence as set forth in SEQ ID NO: 173, and wherein packaged within the rAAV is a nucleic acid comprising a transgene.

41. The rAAV of claim 40, wherein the transgene comprises a tissue-specific promoter operably linked to a coding sequence.

42. The rAAV of claim 41, wherein the coding sequence encodes a therapeutic protein.

43. The rAAV of claim 4, wherein the AAV capsid protein comprises the amino acid sequence as set forth in SEQ ID NO: 174, and wherein packaged within the rAAV is a nucleic acid comprising a transgene.

44. The rAAV of claim 43, wherein the transgene comprises a tissue-specific promoter operably linked to a coding sequence.

45. The rAAV of claim 44, wherein the coding sequence encodes a therapeutic protein.

46. The rAAV of claim 4, wherein the AAV capsid protein comprises the amino acid sequence as set forth in SEQ ID NO: 175, and wherein packaged within the rAAV is a nucleic acid comprising a transgene.

47. The rAAV of claim 46, wherein the transgene comprises a tissue-specific promoter operably linked to a coding sequence.

48. The rAAV of claim 47, wherein the coding sequence encodes a therapeutic protein.

49. The rAAV of claim 4, wherein the AAV capsid protein comprises the amino acid sequence as set forth in SEQ ID NO: 103, and wherein packaged within the rAAV is a nucleic acid comprising a transgene.

50. The rAAV of claim 49, wherein the transgene comprises a tissue-specific promoter operably linked to a coding sequence.

51. The rAAV of claim 50, wherein the coding sequence encodes a therapeutic protein.

* * * * *

UNITED STATES PATENT AND TRADEMARK OFFICE
CERTIFICATE OF CORRECTION

PATENT NO. : 8,734,809 B2  
APPLICATION NO. : 13/322164  
DATED : May 27, 2014  
INVENTOR(S) : Guangping Gao et al.

Page 1 of 1

It is certified that error appears in the above-identified patent and that said Letters Patent is hereby corrected as shown below:

In the specification

Column 1, lines 2-3 insert the following clause before the section entitled RELATED APPLICATIONS:

--STATEMENT OF FEDERALLY SPONSORED RESEARCH

This invention was made with government support under grant nos. DK047757, HL059407 and NS076991 awarded by the National Institutes of Health. The government has certain rights in the invention.--

Signed and Sealed this
Twenty-second Day of March, 2016

Michelle K. Lee
*Director of the United States Patent and Trademark Office*